(12) United States Patent
Gothelf et al.

(10) Patent No.: US 10,046,010 B2
(45) Date of Patent: Aug. 14, 2018

(54) METHODS OF GENERATING MESENCHYMAL STEM CELLS WHICH SECRETE NEUROTROPHIC FACTORS

(71) Applicant: BrainStorm Cell Therapeutics Ltd., Petach-Tikva (IL)

(72) Inventors: Yael Gothelf, Kiryat-Ono (IL); Yosef Levy, Modiln (IL); Alex Burshtein, Rehovot (IL)

(73) Assignee: BrainStorm Cell Therapeutics Ltd., Petach-Tikva (IL)

( * ) Notice: Subject to any disclaimer, the term of this patent is extended or adjusted under 35 U.S.C. 154(b) by 0 days.

(21) Appl. No.: 14/419,668

(22) PCT Filed: Aug. 4, 2013

(86) PCT No.: PCT/IL2013/050660
§ 371 (c)(1),
(2) Date: Feb. 5, 2015

(87) PCT Pub. No.: WO2014/024183
PCT Pub. Date: Feb. 13, 2014

(65) Prior Publication Data
US 2015/0209389 A1    Jul. 30, 2015

Related U.S. Application Data

(60) Provisional application No. 61/679,822, filed on Aug. 6, 2012.

(51) Int. Cl.
| | | |
|---|---|---|
| *A61K 35/28* | (2015.01) | |
| *C12N 5/077* | (2010.01) | |
| *C12N 5/079* | (2010.01) | |
| *C12N 5/0775* | (2010.01) | |
| *G01N 33/50* | (2006.01) | |
| *A61K 35/12* | (2015.01) | |

(52) U.S. Cl.
CPC ............ *A61K 35/28* (2013.01); *C12N 5/0618* (2013.01); *C12N 5/0662* (2013.01); *G01N 33/5023* (2013.01); *A61K 2035/124* (2013.01); *C12N 2500/42* (2013.01); *C12N 2501/01* (2013.01); *C12N 2501/11* (2013.01); *C12N 2501/115* (2013.01); *C12N 2501/135* (2013.01); *C12N 2501/195* (2013.01); *C12N 2506/1353* (2013.01); *G01N 2333/70585* (2013.01); *G01N 2333/71* (2013.01); *G01N 2333/916* (2013.01)

(58) Field of Classification Search
None
See application file for complete search history.

(56) References Cited

U.S. PATENT DOCUMENTS

2010/0184033 A1   7/2010  West et al.
2016/0334392 A1  11/2016  Gothelf et al.

FOREIGN PATENT DOCUMENTS

| | | | |
|---|---|---|---|
| DE | 102011121982 | 4/2013 | |
| EP | 1479767 | 11/2004 | |
| WO | WO 2004/046348 | 6/2004 | |
| WO | WO 2006/134602 | 12/2006 | |
| WO | WO 2007/066338 | 6/2007 | |
| WO | WO 2009/144718 | 12/2009 | |
| WO | WO 2009144718 A1 * | 12/2009 | ........... C12N 5/0618 |
| WO | WO 2011/063005 | 5/2011 | |
| WO | WO 2014/024183 | 2/2014 | |
| WO | WO 2015/121859 | 8/2015 | |

OTHER PUBLICATIONS

Rollins et al. "Increase in endogenous and exogenous cyclic AMP levels inhibits sclerotial development in Sclerotinia sclerotiorum", Applied and Environmental Microbiology 64(7): 2539-2544, 1998.*
Matsuse et al. "Human umbilical cord-derived mesenchymal stromal cells differentiate into functional Schwann cells that sustain peripheral nerve regeneration", Journal of Neuropathology & Experimental Neurology 69(9): 973-985, 2010.*
Corning "Dulbecco's Modification of Eagle's Medium (DMEM) Formulation", available on compay's webpage <http://cellgro.com/media/docs/files/items///DMEM_2.pdf>, accessed May 23, 2017, copyright 2012.*
Movaghar et al. "Transdifferentiation of bone marrow stromal cells into Schwann cell phenotype using progesterone as inducer", Brain Research 1208: 17-24, 2008.*
International Preliminary Report on Patentability dated Feb. 19, 2015 From the International Bureau of WIPO Re. Application No. PCT/IL2013/050660.
International Search Report and the Written Opinion dated Jun. 15, 2015 From the International Searching Authority Re. Application No. PCT/IL2015/050159.
International Search Report and the Written Opinion dated Nov. 22, 2013 From the International Searching Authority Re. Application No. PCT/IL2013/050660.
Abbaszadch et al. "Bone Marrow Stromal Cell Transdiffcrcntiation Into Oligodendrocyte-Like Cells Using Triiodothyronine as A Inducer With Expression of Platelet-Derived Growth Factor Alpha as A Maturity Marker", Iranian Biomedical Journal, 17(2): 62-70, Apr. 2013.
Bossolasco et al. "Neuro-Glial Differentiation of Human Bone Marrow Stem Cells In Vitro", Experimental Neurology, XP004875161, 193(2): 312-325, Jun. 1, 2005.
Choudhery et al. "Comparison of Human Mesenchymal Stem Cells Derived From Adipose and Cord Tissue", Cytotherapy, XP002716010, 15(3): 330-343, Mar. 2013. Fig.2.
Dezawa et al. "Specific Induction of Neuronal Cells From Bone Marrow Stromal Cells and Application for Autologous Transplantation", The Journal of Clinical Investigation, XP002311058, 113(12): 1701-1710, Jun. 1, 2004.
Garcia et al. "Bone Marrow Stromal Cells Produce Nerve Growth Factor and Glial Cell Line-Derived Neurotrophic Factors", Biochemical and Biophysical Research Communications, XP004495951, 316(3): 753-754, Apr. 9, 2004. Fig.1.
Kaka et al. "In Vitro Differentiation of Bone Marrow Stromal Cells Into Oligodendrocyte-Like Cells Using Triiodothyronine as Inducer", International Journal of Neuroscience, XP008165743, 122(5): 237-247, May 1, 2012. Table 1.

(Continued)

*Primary Examiner* — Emily A Cordas

(57) ABSTRACT

A method of generating MSCs which secrete neurotrophic factors (NTFs) comprising incubating a population of undifferentiated mesenchymal stem cells (MSCs) in a differentiating medium comprising basic fibroblast growth factor (bFGF), platelet derived growth factor (PDGF), heregulin and cAMP.

12 Claims, 32 Drawing Sheets
(26 of 32 Drawing Sheet(s) Filed in Color)

(56) References Cited

OTHER PUBLICATIONS

Kaka et al. "In Vitro Differentiation of Bone Marrow Stromal Cells into Oligodendrocyte-Like Cells Using Triiodothyronine as Inducer",The International Journal of Neuroscience, XP008165743, 122 (5):237-247, May 1, 2012. Abstract, Fig. 7, Table 1.
Kohyama et al. "Brain From Bone: Efficient 'Meta-Differentiation' of Marrow Stroma-Derived Mature Osteoblasts to Neurons With Noggin or A Demethylating Agent", Differentiation, XP002974601, 68(4-5): 235-244, Oct. 1, 2001. p. 237, r-h Col., Para. 2.
Kurozumi et al. "BDNF Gene-Modified Mesenchymal Stem Cells Promote Functional Recovery and Reduce Infarct Size in the Rat Middle Cerebral Artery Occlusion Model", Molecular Therapy, XP009117446, 9(2): 189-197, Feb. 1, 2004.
Lakshmipathy et al. "Concise Review: MicroRNA Expression in Multipotent Mesenchymal Stromal Cells", Stem Cells, XP055077003, 26(2): 356-363, Feb. 1, 2008.
Office Action dated Apr. 14, 2016 From the Israel Patent Office Re. Application No. 237124 and Its Translation Into English.
International Preliminary Report on Patentability dated Aug. 25, 2016 From the International Bureau of WIPO Re. Application No. PCT/L2015/050159.
Communication Pursuant to Article 94(3) EPC dated Jun. 13, 2016 From the European Patent Office Re. Application No. 13767124.4.
Notice of Reason for Rejection dated May 23, 2017 From the Japan Patent Office Re. Application No. 2015-526006 and Its Translation Into English. (9 Pages).
Office Action dated Jun. 29, 2017 From the Israel Patent Office Re. Application No. 237124 and Its Translation Into English. (4 Pages).
Halfon et al. "Markers Distinguishing Mesenchymal Stem Cells From Fibroblasts Are Downregulated With Passaging", Stem Cells and Development, 20(1): 53-66, Dec. 2011.
Communication Pursuant to Article 94(3) EPC dated May 24, 2017 From the European Patent Office Re. Application No. 13767124.4. (4 Pages).
Decision of Rejection dated Jan. 5, 2018 From the Japan Patent Office Re. Application No. 2015-526006 and Its Translation Into English. (12 Pages).
Restriction Official Action dated Dec. 18, 2017 From the US Patent and Trademark Office Re. U.S. Appl. No. 15/113,105. (8 pages).
Park et al. "Human Mesenchymal Stem Cell-Derived Schwann Cell-Like Cells Exhibit Neurotrophic Effects, Via Distinct Growth Factor Production, in a Model of Spinal Cord Injury", Glia, 58(9): 1118-1132, Published Online Mar. 29, 2010.

* cited by examiner

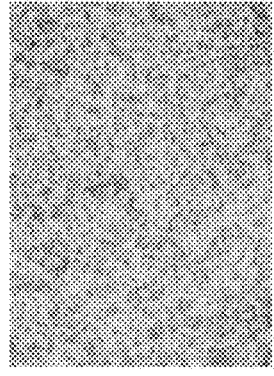
FIG. 3A
60p2
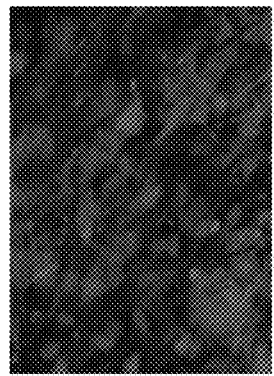
FIG. 3D
Osteocytes
(DAPI + Osteocalcin)
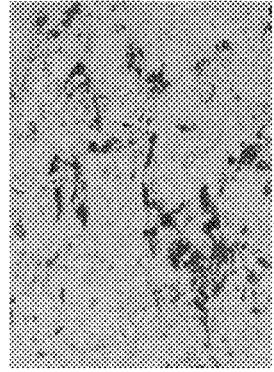
FIG. 3G
Chondrocytes
(Alcian Blue)
Adipocytes
(oil red O)
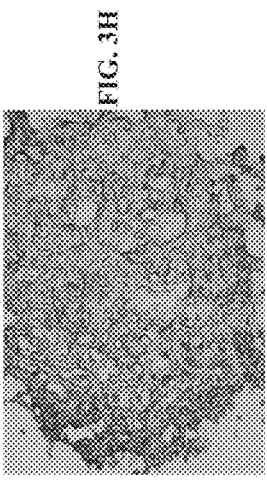
FIG. 3H
61p2
FIG. 3B
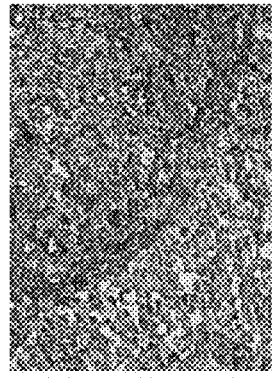
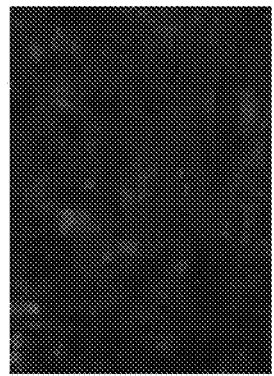
FIG. 3I
FIG. 3F
62p2
FIG. 3C

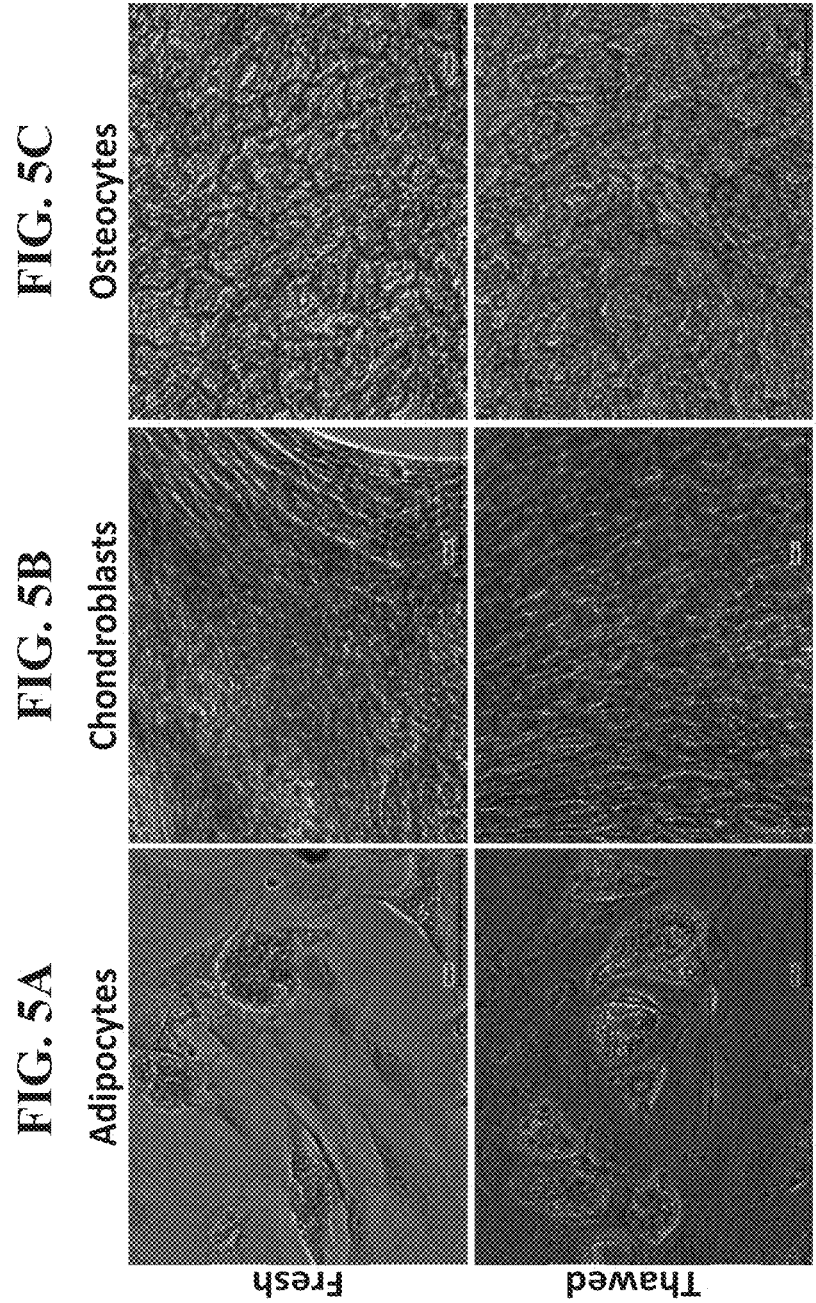

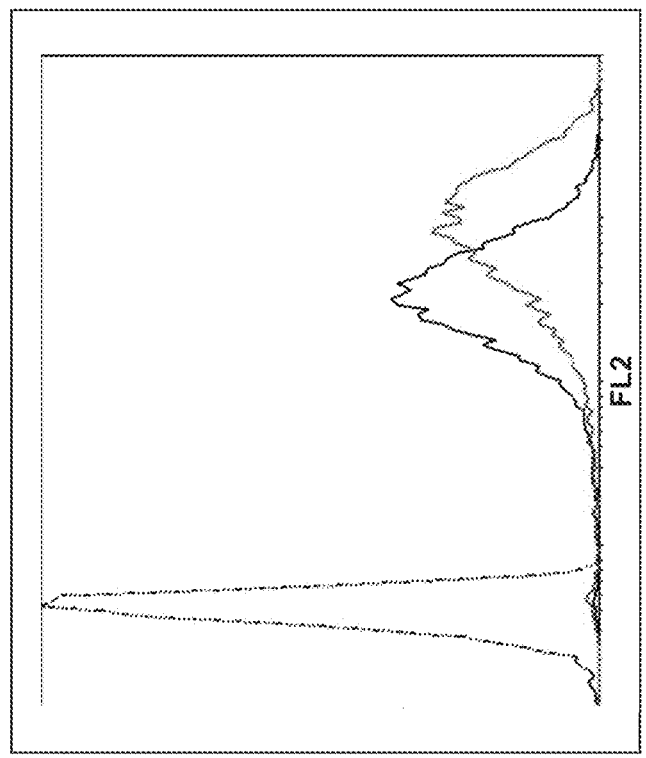
FIG. 13A CD44
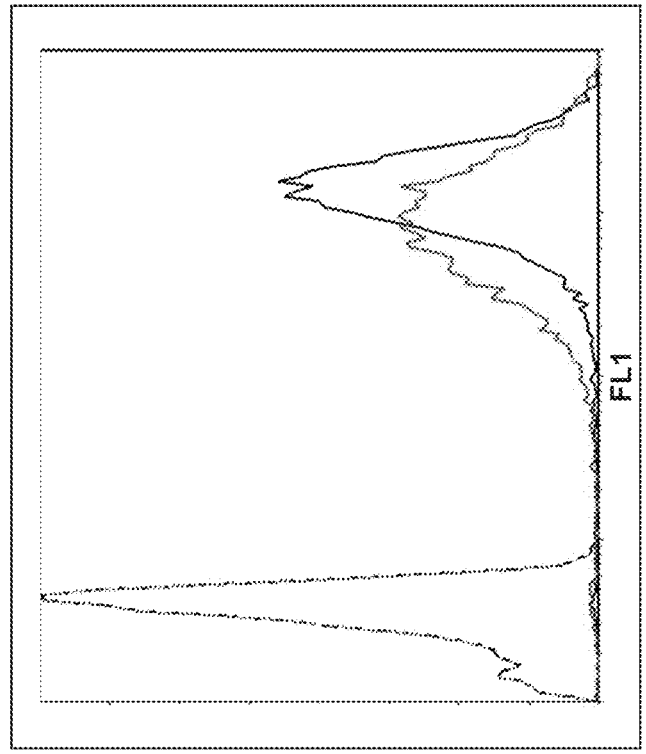
FIG. 13B CD73

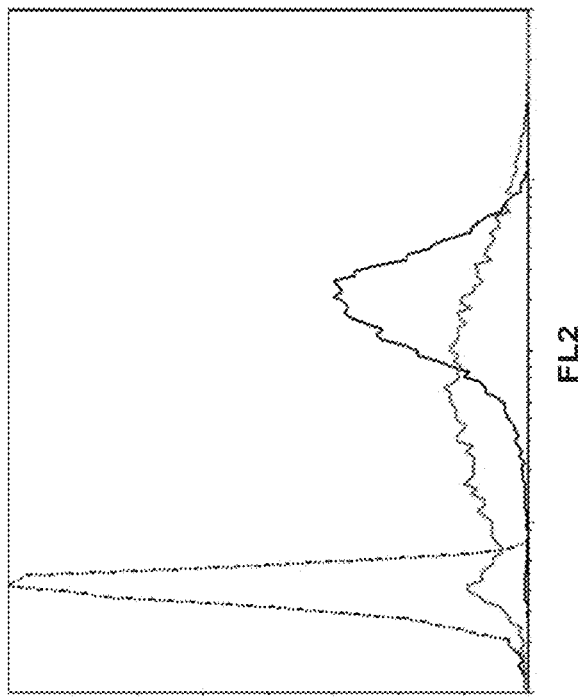
FIG. 14A Day 2
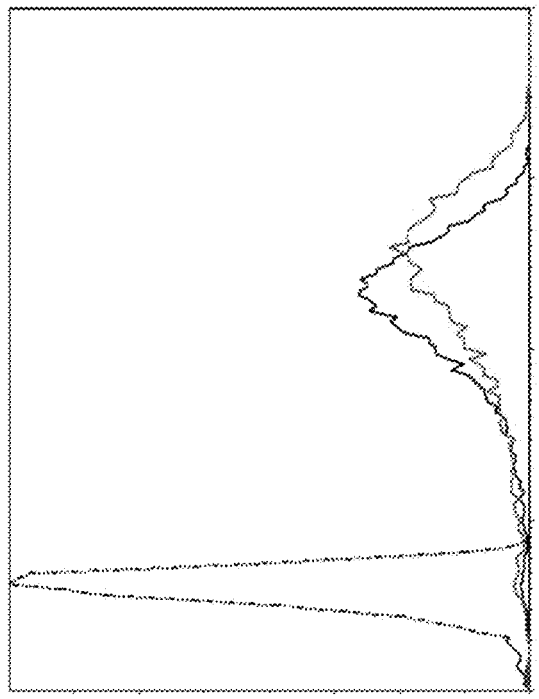
FIG. 14B Day 3

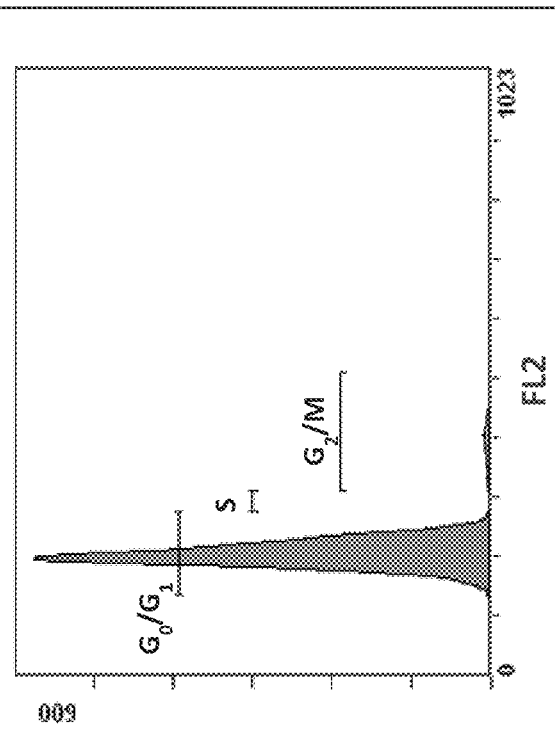
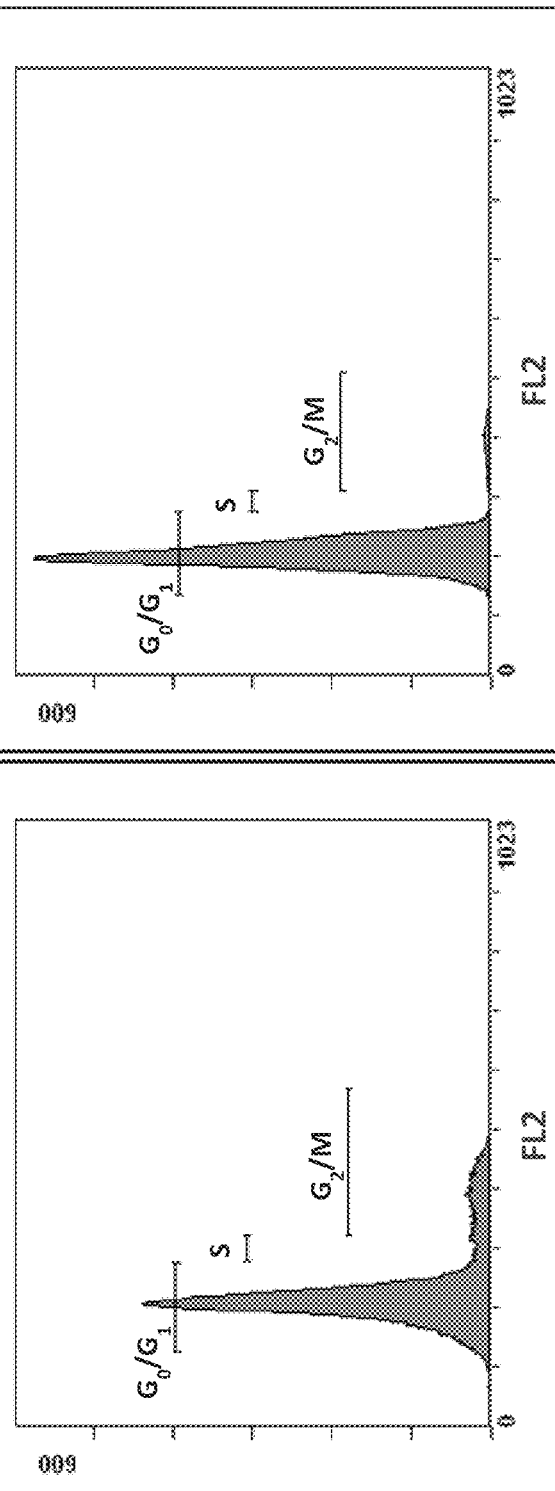
FIG. 15B  MSC-NTF
FIG. 15A  MSC

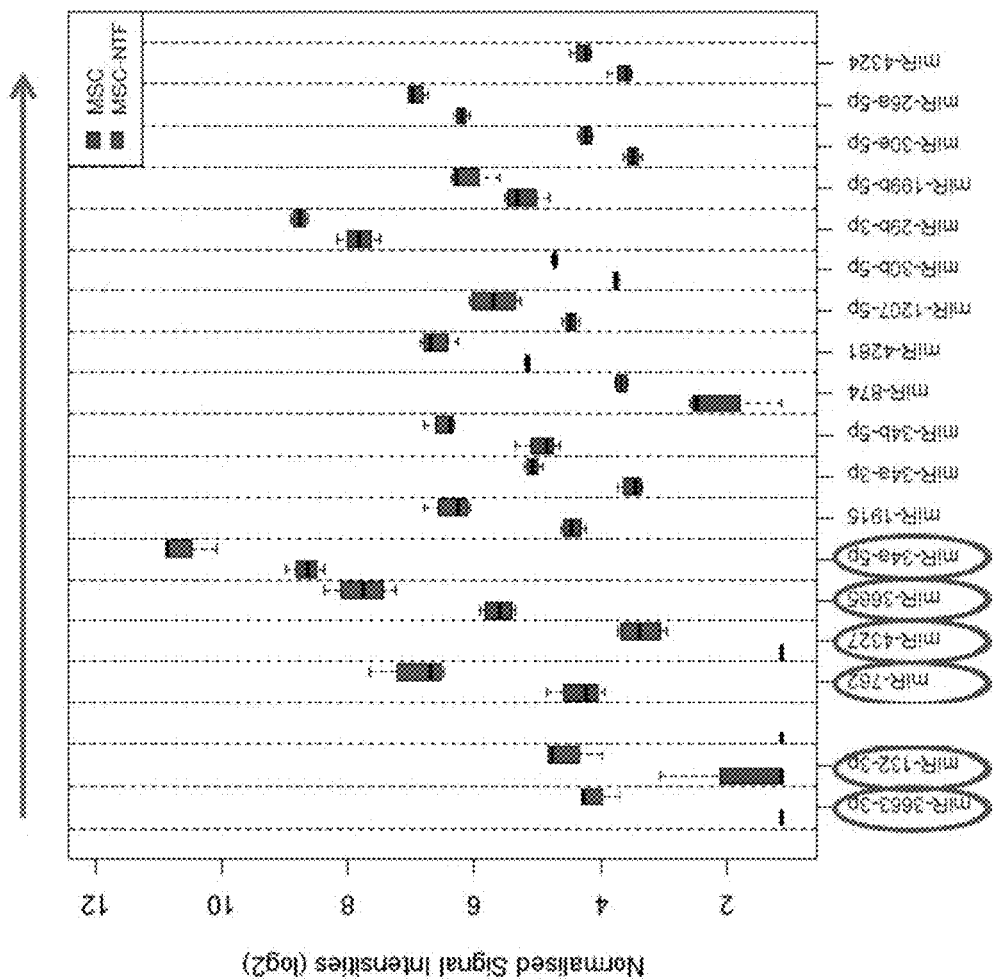

US 10,046,010 B2

METHODS OF GENERATING MESENCHYMAL STEM CELLS WHICH SECRETE NEUROTROPHIC FACTORS

RELATED APPLICATIONS

This application is a National Phase of PCT Patent Application No. PCT/IL2013/050660 having International filing date of Aug. 4, 2013, which claims the benefit of priority under 35 USC § 119(e) of U.S. Provisional Patent Application No. 61/679,822 filed on Aug. 6, 2012. The contents of the above applications are all incorporated by reference as if fully set forth herein in their entirety.

SEQUENCE LISTING STATEMENT

The ASCII file, entitled 60368SequenceListing.txt, created on Sep. 3, 2014, comprising 724,206 bytes, submitted concurrently with the filing of this application is incorporated herein by reference.

FIELD AND BACKGROUND OF THE INVENTION

The present invention, in some embodiments thereof, relates to methods of generating cells from mesenchymal stem cells that secrete neurotrophic factors and, methods of selecting same.

Amyotrophic lateral sclerosis (ALS) is one of the most common neurodegenerative diseases in adults. It is a fatal progressive neurodegenerative disease characterized by motor-neuron cell death in the brain and spinal cord accompanied by rapid loss of muscle function and eventual complete paralysis.

Current experimental ALS drugs are developed on the basis of putative pathophysiologic mechanisms, such as anti-glutamatergic agents, drugs targeting protein misfolding and accumulation, antioxidant therapy, immunomodulatory agents, and stem cells.

Of the current investigational therapies, stem cell transplantation may have the most potential. Apart from the replacement of lost or damaged motor neurons, stem cell implantation therapy may benefit ALS patients by an independent effect of cytoprotection. Further, there is the potential for stem cells to differentiate into supportive interstitial cells including astrocytes and microglia which can potentially produce neurotrophic factors as well as enzymatic and paracrine mediators which antagonize neurotoxicity. Further experimental data have shown that non-neuronal cell replacement can be a strategic therapy in promoting motor neuron survival and improved neuromuscular function (Corti S et al. 2010).

The use of stem cells as a cellular source in cell replacement therapy for additional neurodegenerative diseases including Parkinson's disease and multiple sclerosis has also been suggested.

Neurotrophic factors (NTF) are small, naturally occurring polypeptides that support the development and survival of neurons, and therefore have been considered in the past few years as candidates for therapy options for different neurodegenerative diseases including ALS. Studies in ALS animal models have shown a delay in disease onset and/or progression after administration of various neurotrophic factors.

However, clinical trials of systematic or intrathecal administration of recombinant growth factors to ALS patients have not been effective, probably due in part to their short half-life, low concentrations at target sites, and high incidence of side effects.

Several studies have shown that mesenchymal stem cells (MSCs) following exposure to different factors in vitro, change their phenotype and demonstrate neuronal and glial markers [Kopen, G. C., et al., Proc Natl Acad USA. 96(19): 10711-6, 1999; Sanchez-Ramos, et al. Exp Neurol. 164(2): 247-56. 2000; Woodbury, D., J Neurosci Res. 61(4):364-70, 2000; Woodbury, D., et al., J Neurosci Res. 69(6):908-17, 2002; Black, I. B., Woodbury, D. Blood Cells Mol Dis. 27(3):632-6, 2001; Kohyama, J., et al. Differentiation. 68(4-5):235-44, 2001; Levy, Y. S. J Mol Neurosci. 21(2):121-32, 2003, Blondheim N. R., Stem Cells & Dev. 15:141-164, 2006]

WO2006/134602 and WO2009/144718 teaches differentiation protocols for the generation of neurotrophic factor secreting cells from mesenchymal stem cells.

WO2007/066338 teaches differentiation protocols for the generation of oligodendrocyte-like cells from mesenchymal stem cells.

WO2004/046348 teaches differentiation protocols for the generation of neuronal-like cells from mesenchymal stem cells.

Abbaszadeh et al [Iranian Biomedical Journal 17 (2): 62-70 (April 2013)] teaches a two step differentiation protocol for the generation of oligodendrocytes from MSCs where one of the media comprises PDGF, heregulin, bFGF and triiodothyronine.

SUMMARY OF THE INVENTION

According to an aspect of some embodiments of the present invention there is provided a method of generating cells which secrete neurotrophic factors (NTFs) comprising incubating a population of undifferentiated mesenchymal stem cells (MSCs) in a differentiating medium comprising basic fibroblast growth factor (bFGF), platelet derived growth factor (PDGF), heregulin and cAMP.

According to an aspect of some embodiments of the present invention there is provided an isolated population of cells which secretes neurotrophic factors, generated according to the methods described herein.

According to an aspect of some embodiments of the present invention there is provided a method of treating a disease for which administration of neurotrophic factors is beneficial in a subject in need thereof, comprising administering to the subject a therapeutically effective amount of the isolated population of cells described herein, thereby treating the disease.

According to an aspect of some embodiments of the present invention there is provided a method of selecting cells which secrete neurotrophic factors (NTFs) from a mixed population of MSCs, comprising:

a) analyzing the cells of the mixed population of cells for at least one of the following parameters:
(i) cells which express CD44 below a predetermined threshold;
(ii) cells which express CD73 above a predetermined threshold; and (b) selecting cells which are positive for at least one of the parameters, thereby selecting the cells which secrete neurotrophic factors.

According to an aspect of some embodiments of the present invention there is provided a pharmaceutical composition comprising the isolated population of cells described herein as an active agent and a pharmaceutically acceptable carrier.

According to an aspect of some embodiments of the present invention there is provided a method of qualifying cells useful for treating a disease which have been ex vivo differentiated from MSCs and which secrete neurotrophic factors, comprising analyzing the cells for expression at least one protein selected from the group consisting of Isobutyryl-CoA dehydrogenase, C-X-C motif chemokine 6, Neuromodulin, Growth/differentiation factor 15, Hyaluronan synthase 1, Interleukin-1 beta, Interleukin-8, Inhibin beta A chain, Insulin receptor substrate 1, Integrin alpha-1, Laccase domain-containing protein 1, Laminin subunit alpha-4, Lumican, Collagenase 3, Normal mucosa of esophagus-specific gene 1 protein, Pre-B-cell leukemia transcription factor-interacting protein 1, Pleckstrin homology-like domain family A member 1, Phosphatidylinositol 3,4,5-trisphosphate-dependent Rac exchanger 1 protein, Prostaglandin E synthase, Prostaglandin G/H synthase 2, Ras-related protein Rab-27B, Rho-related GTP-binding protein RhoB, Sialate O-acetylesterase, Monocarboxylate transporter 7, Tissue factor pathway inhibitor 2, Transmembrane protein 65, Vam6/Vps39-like protein, 3-oxo-5-beta-steroid 4-dehydrogenase, Propionyl-CoA carboxylase beta chain, mitochondrial, Interferon regulatory factor 2-binding protein-like, Tissue alpha-L-fucosidase, Aldo-keto reductase family 1 member C2, Inositol 1,4,5-trisphosphate receptor-interacting protein, Protein KIAA1199, Selenium-binding protein 1, Phospholipase D3, GTP:AMP phosphotransferase, mitochondrial, Protein Wnt-5a; Protein Wnt, Aldo-keto reductase family 1 member C3, Sorting nexin-9, Gap junction alpha-1 protein, Pyruvate carboxylase, mitochondrial, SH3 and PX domain-containing protein 2B, Integrin alpha-2, Cytochrome P450 1B1, Chitinase-3-like protein 1, Nicotinamide phosphoribosyltransferase, Seprase, Superoxide dismutase, Aldo-keto reductase family 1 member C1, FERM, RhoGEF and pleckstrin domain-containing protein 1, Prolyl 4-hydroxylase subunit alpha-3, Ribonucleoside-diphosphate reductase subunit M2 B, Core histone macro-H2A.2; Histone H2A, Choline transporter-like protein 1 and Niemann-Pick C1 protein, Lysosomal alpha-glucosidase, wherein an increase in expression of the at least one protein compared to non-differentiated MSCs is indicative that the cells are useful for treating a disease.

According to an aspect of some embodiments of the present invention there is provided a method of qualifying cells useful for treating a disease which have been ex vivo differentiated from MSCs and which secrete neurotrophic factors, comprising analyzing the cells for expression at least one protein selected from the group consisting of Tight junction protein ZO-2, Alpha-1,3-mannosyl-glycoprotein 2-beta-N-acetylglucosaminyltransferase, Smoothelin, Ectopic P granules protein 5 homolog, BRCA1-associated ATM activator 1, WD repeat-containing protein 36, SH3 domain-binding protein 4, EH domain-binding protein 1-like protein 1, Ras GTPase-activating-like protein IQGAP3, Lysyl oxidase homolog 2, Tropomyosin 1 (Alpha), isoform CRA_f, Gem-associated protein 5, Tripartite motif-containing protein 16, Connective tissue growth factor, Lymphokine-activated killer T-cell-originated protein kinase, Tetratricopeptide repeat protein 4, Breast cancer anti-estrogen resistance protein 1, Ribonucleoside-diphosphate reductase subunit M2, Ubiquitin-conjugating enzyme E2 C, Neutrophil defensin 1, Cdc42 effector protein 3, Condensin complex subunit 2, Ig kappa chain C region, Condensin complex subunit 3, Syncoilin, Structural maintenance of chromosomes protein 2, Condensin complex subunit 1, Inter-alpha-trypsin inhibitor heavy chain H4, Thymidylate synthase, Serotransferrin, Pregnancy zone protein, DNA replication licensing factor MCMl, Hemopexin DNA mismatch repair protein Msh6, Ankyrin repeat domain-containing protein 13A, Phosducin-like protein 3, 1-phosphatidylinositol 4,5-bisphosphate phosphodiesterase beta-3, Complement C3; DNA replication licensing factor MCM3, CD97 antigen; CD97 antigen subunit alpha, DNA replication licensing factor MCM6, DNA replication licensing factor MCM4, Disabled homolog 2, Protein KIAA0664, DNA replication licensing factor MCM2, Protein-lysine 6-oxidase, Ribonucleoside-diphosphate reductase large subunit, Melanoma-associated antigen D2, Ig gamma-1 chain C region, Heparanase, Importin subunit alpha-2, Asparagine synthetase [glutamine-hydrolyzing], Alpha-2-macroglobulin, Collagen alpha-1(I) chain, Collagen alpha-1(V) chain, DnaJ homolog subfamily B member 4, Thrombospondin-1, Serum albumin and Collagen alpha-2(I) chain, wherein a decrease in expression of the at least one protein compared to non-differentiated cells is indicative that the cells are useful for treating a disease.

According to an aspect of some embodiments of the present invention there is provided an isolated population of cells which secretes neurotrophic factors, wherein the cells express each of the mesenchymal stem cell markers CD44, CD73, CD90, and CD105 and do not express any of the surface markers CD3, CD14, CD19, CD34, CD45 and HLA-DR, as detected by flow cytometry.

According to an aspect of some embodiments of the present invention there is provided a method of qualifying cells useful for treating a disease which have been ex vivo differentiated from MSCs and which secrete neurotrophic factors, comprising analyzing the cells for expression at least one miRNA selected from the group consisting of miR-503-5p, miR-3659, miR-3529-3p, miR-320b, miR-424-5p, miR-320a, miR-222-3p, miR-3663-3p, miR-762, miR-4327, miR-3665, miR34a-5p, miR-4327, miRNA-3665 and miR132-3p; wherein an increased expression of the miR-3663-3p, miR-762, miR-4327, miR-3665, miR34a-5p, miR-4327, miRNA 3665 or miR132-3p compared to non-differentiated MSCs, or a decreased expression of the miR-503-5p, miR-3659, miR-3529-3p, miR-320b, miR-424-5p, miR-320a or miR-222-3p, compared to non-differentiated MSCs is indicative of cells which are useful for treating a disease.

According to some embodiments of the invention, the differentiating medium is devoid of a phosphodiesterase inhibitor.

According to some embodiments of the invention, the differentiating medium is devoid of triiodothyronine.

According to some embodiments of the invention, the phosphodiesterase inhibitor comprises IBMX.

According to some embodiments of the invention, the differentiating medium is devoid of xeno derived components.

According to some embodiments of the invention, the method further comprises culturing the population of undifferentiated MSCs prior to the incubating, wherein the culturing is effected under conditions that do not promote cell differentiation.

According to some embodiments of the invention, the culturing is effected for three days following seeding of the undifferentiated MSCs.

According to some embodiments of the invention, the seeding is effected at a density of about 6000-8000 cm$^2$.

According to some embodiments of the invention, the culturing is effected in a culture medium comprising platelet lysate.

According to some embodiments of the invention, the percentage of the platelet lysate in the culture medium is about 10%.

According to some embodiments of the invention, the culture medium further comprises L-glutamine, sodium pyruvate and heparin.

According to some embodiments of the invention, the method further comprises analyzing an expression of CD44 and/or CD73 on a surface of the cells.

According to some embodiments of the invention, the method further comprises analyzing an expression of CD105 on the surface of the cells.

According to some embodiments of the invention, the method further comprises comparing the expression with an expression of CD44 and/or CD73 on a surface of undifferentiated MSCs.

According to some embodiments of the invention, the cells express each of the mesenchymal stem cell markers CD44, CD73, CD90, and CD105, as detected by flow cytometry.

According to some embodiments of the invention, the cells are not expressing any of the surface markers CD3, CD14, CD19, CD34, CD45 and HLA-DR, as detected by flow cytometry.

According to some embodiments of the invention, the cells are non-genetically modified.

According to some embodiments of the invention, the cells are ex vivo differentiated from MSCs which are autologous to the subject.

According to some embodiments of the invention, the cells are ex vivo differentiated from MSCs which are allogeneic to the subject.

According to some embodiments of the invention, the cells are ex vivo differentiated from MSCs which are derived from the bone marrow of the subject.

According to some embodiments of the invention, the disease is a neurodegenerative disease or an immune disease.

According to some embodiments of the invention, the neurodegenerative disease is selected from the group consisting of Parkinson's, Multiple System Atrophy (MSA), multiple sclerosis, epilepsy, amyotrophic lateral sclerosis (ALS), stroke, autoimmune encephalomyelitis, diabetic neuropathy, glaucomatous neuropathy, Alzheimer's disease, and Huntingdon's disease.

According to some embodiments of the invention, the neurodegenerative disease is ALS.

According to some embodiments of the invention, the immune disease is an autoimmune disease.

According to some embodiments of the invention, the autoimmune disease is myasthenia gravis.

According to some embodiments of the invention, the administering is effected intramuscularly and/or intrathecally.

According to some embodiments of the invention, when the administering is effected intramuscularly, a total amount of cells administered to a 70 kg subject is between 20-100×$10^6$ cells.

According to some embodiments of the invention, when the administering is effected intrathecally, an amount of MSC-NTFs administered to a 70 kg subject is between 50-200×$10^6$ cells per administration.

According to some embodiments of the invention, when the administering is effected intrathecally and intramuscularly, a total amount of MSC-NTFs administered to a 70 kg subject is between 20-500×$10^6$ cells.

According to some embodiments of the invention, the method further comprises analyzing a level of CD105 on the cells and selecting cells which express CD105 below a predetermined level.

According to some embodiments of the invention, the NTFs comprises glial derived neurotrophic factor (GDNF) and brain derived neurotrophic factor (BDNF).

According to some embodiments of the invention, the method further comprises incubating a population of undifferentiated MSCs in a differentiating medium so as to generate MSCs which secrete NTFs prior to the analyzing.

According to some embodiments of the invention, the pharmaceutically acceptable carrier maintains the number of cells in the composition for at least 48 hours.

According to some embodiments of the invention, the miRNAs are selected from the group consisting of miR-503-5p, miR-320b, miR424-5p, miR-132-3p and miR-34a-5p.

According to some embodiments of the invention, the neurotrophic factors are selected from the group consisting of BDNF, GDNF, VEGF and HGF.

According to some embodiments of the invention, the neurotrophic factors comprise BDNF, GDNF, VEGF and HGF.

According to some embodiments of the invention, the cells are non-genetically modified.

According to some embodiments of the invention, the cells exhibit an increased expression of a miRNA selected from the group consisting of miR34a-5p, miR-222-3p, miR762, miRNA 3663-3p or miR132-3p compared to non-differentiated MSCs.

According to some embodiments of the invention, the cells exhibit a decreased expression of at least one miRNAs selected from the group consisting of miR-503-5p, miR-320b, miR-424-5p, miR-320a or miR-222-3p, compared to non-differentiated MSCs.

According to some embodiments of the invention, the cells exhibit an increased expression of one or more of Isobutyryl-CoA dehydrogenase, C-X-C motif chemokine 6, Neuromodulin, Growth/differentiation factor 15, Hyaluronan synthase 1, Interleukin-1 beta, Interleukin-8, Inhibin beta A chain, Insulin receptor substrate 1, Integrin alpha-1, Laccase domain-containing protein 1, Laminin subunit alpha-4, Lumican, Collagenase 3, Normal mucosa of esophagus-specific gene 1 protein, Pre-B-cell leukemia transcription factor-interacting protein 1, Pleckstrin homology-like domain family A member 1, Phosphatidylinositol 3,4,5-trisphosphate-dependent Rac exchanger 1 protein, Prostaglandin E synthase, Prostaglandin G/H synthase 2, Ras-related protein Rab-27B, Rho-related GTP-binding protein RhoB, Sialate O-acetylesterase, Monocarboxylate transporter 7, Tissue factor pathway inhibitor 2, Transmembrane protein 65, Vam6/Vps39-like protein, 3-oxo-5-beta-steroid 4-dehydrogenase, Propionyl-CoA carboxylase beta chain, mitochondrial, Interferon regulatory factor 2-binding protein-like, Tissue alpha-L-fucosidase, Aldo-keto reductase family 1 member C2, Inositol 1,4,5-trisphosphate receptor-interacting protein, Protein KIAA1199, Selenium-binding protein 1, Phospholipase D3, GTP:AMP phosphotransferase, mitochondrial, Protein Wnt-5a; Protein Wnt, Aldo-keto reductase family 1 member C3, Sorting nexin-9, Gap junction alpha-1 protein, Pyruvate carboxylase, mitochondrial, SH3 and PX domain-containing protein 2B, Integrin alpha-2, Cytochrome P450 1B1, Chitinase-3-like protein 1, Nicotinamide phosphoribosyltransferase, Seprase, Superoxide dismutase, Aldo-keto reductase family 1 member C1, FERM, RhoGEF and pleckstrin domain-containing protein 1, Prolyl 4-hydroxylase subunit alpha-3, Ribonucleoside-diphosphate reductase subunit M2 B, Core histone macro-H2A.2; Histone H2A, Choline transporter-like protein 1 and Niemann-Pick C1 protein, or Lysosomal alpha-glucosidase, compared to non-differentiated MSCs.

According to some embodiments of the invention, the cells exhibit a decreased expression of one or more of Tight junction protein ZO-2, Alpha-1,3-mannosyl-glycoprotein 2-beta-N-acetylglucosaminyltransferase, Smoothelin, Ectopic P granules protein 5 homolog, BRCA1-associated ATM activator 1, WD repeat-containing protein 36, SH3 domain-binding protein 4, EH domain-binding protein 1-like protein 1, Ras GTPase-activating-like protein IQGAP3, Lysyl oxidase homolog 2, Tropomyosin 1 (Alpha), isoform CRA_f, Gem-associated protein 5, Tripartite motif-containing protein 16, Connective tissue growth factor, Lymphokine-activated killer T-cell-originated protein kinase, Tetratricopeptide repeat protein 4, Breast cancer anti-estrogen resistance protein 1, Ribonucleoside-diphosphate reductase subunit M2, Ubiquitin-conjugating enzyme E2 C, Neutrophil defensin 1, Cdc42 effector protein 3, Condensin complex subunit 2, Ig kappa chain C region, Condensin complex subunit 3, Syncoilin, Structural maintenance of chromosomes protein 2, Condensin complex subunit 1, Inter-alpha-trypsin inhibitor heavy chain H4, Thymidylate synthase, Serotransferrin, Pregnancy zone protein, DNA replication licensing factor MCMl, Hemopexin DNA mismatch repair protein Msh6, Ankyrin repeat domain-containing protein 13A, Phosducin-like protein 3, 1-phosphatidylinositol 4,5-bisphosphate phosphodiesterase beta-3, Complement C3; DNA replication licensing factor MCM3, CD97 antigen; CD97 antigen subunit alpha, DNA replication licensing factor MCM6, DNA replication licensing factor MCM4, Disabled homolog 2, Protein KIAA0664, DNA replication licensing factor MCM2, Protein-lysine 6-oxidase, Ribonucleoside-diphosphate reductase large subunit, Melanoma-associated antigen D2, Ig gamma-1 chain C region, Heparanase, Importin subunit alpha-2, Asparagine synthetase [glutamine-hydrolyzing], Alpha-2-macroglobulin, Collagen alpha-1(I) chain, Collagen alpha-1(V) chain, DnaJ homolog subfamily B member 4, Thrombospondin-1, Serum albumin or Collagen alpha-2(I) chain, compared to non-differentiated MSCs.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWING(S)

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 1A-B are graphs illustrating the stability of final product at concentrations suitable for two routes of administration in this case, as measured by viable cell count using the Trypan blue exclusion dye. Stability of ALS patient's MSC-NTF final product was evaluated at 2-8° C. for up to 7 hours post-harvest at two cell concentrations: $10 \times 10^6$ cells/ml (A) for the intramuscular (IM) transplantation route and $35 \times 10^6$ cells/ml (B) for the intrathecal (IT) transplantation. The cells were incubated for 5 hours in a 50 ml tube and then transferred to 1 ml and 5 ml syringes respectively for two more hours.

FIG. 2 is a graph illustrating the cell number of MSCs derived from ALS patients following long term propagation. Propagation of bone marrow derived MSC of seven ALS patients is shown over 5-7 passages for up to 60 days. Cell numbers were determined at every passage and cumulative population doublings (PD) were calculated. PD=Log 10(number of cells harvested at the end of passage)–Log (number of seeded cells at the beginning of passage)/Log$_2$. The total number of PD corresponded to the addition of the PD for all passages. The first PDs were determined in relation to cell numbers after the first passage (P1).

FIGS. 3A-I are photographs of MSC of three donors (#60, #61 and #62) at passage 2 which were induced to differentiate into adipocytes (FIGS. 3A-C), osteocytes (FIGS. 3D-F) and chondrocytes (FIGS. 3G-I).

FIGS. 4A-B are pictures of the results of chromosome analysis as performed by the G-banding technique. Cultured MSC of an ALS patient were harvested at an early passage—P2 (A) and at a late passage—P5 (B). Cells displayed a normal karyotype at both passages.

FIGS. 5A-F are photographs of MSC of the same ALS patient at passage 3 which were induced to differentiate into adipoctes, osteocytes and chondrocytes prior to (FIGS. 5A-C) and following cryopreservation (FIGS. 5D-F)

FIGS. 6A-B are graphs illustrating GDNF and BDNF productivity of MSC-NTF cells. Productivity of MSC-NTF cells (red) of 12 ALS patients as compared to productivity of MSC (blue) of the same patient analysed in the same ELISA assay. GDNF secretion is induced 2-20 or more fold in MSC-NTF as compared to MSC of the same patient, and BDNF secretion is induced 1.5-5 fold in MSC-NTF as compared to MSC of the same patient.

Figure 9:
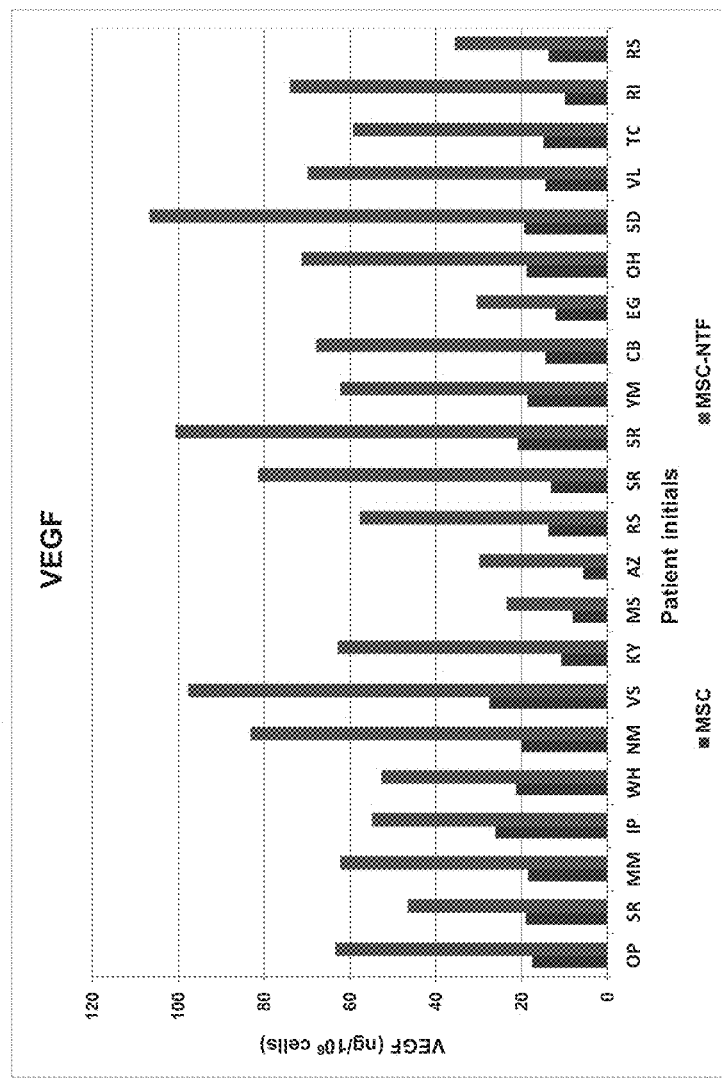

FIG. 9 is a graph illustrating VEGF productivity of MSC-NTF cells. Productivity of MSC-NTF cells (red) of 22 ALS patients as compared to productivity of MSC (blue) of the same patient analysed in the same ELISA assay. VEGF secretion is induced $4.1 \pm 1.4$ or more fold in MSC-NTF as compared to MSC of the same patient.

Figure 10:
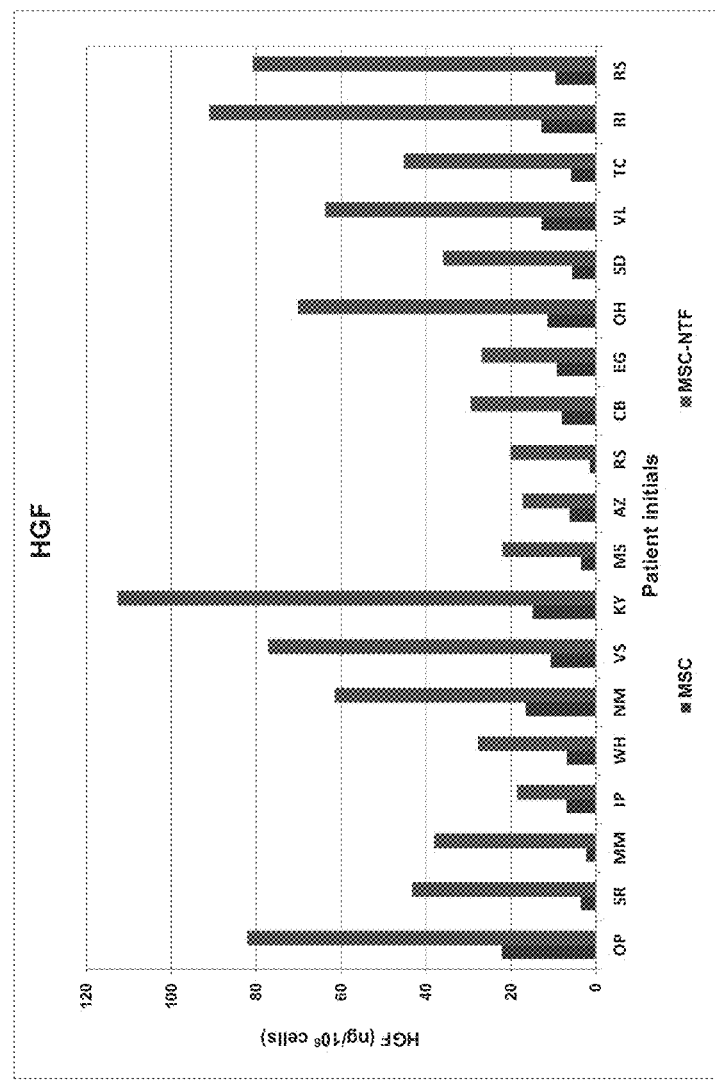

FIG. 10 is a graph illustrating HGF productivity of MSC-NTF cells. Productivity of MSC-NTF cells (red) of 19 ALS patients as compared to productivity of MSC (blue) of the same patient analysed in the same ELISA assay. HGF secretion is induced $6.7 \pm 3.9$ or more fold in MSC-NTF as compared to MSC of the same patient.

Figure 11A:
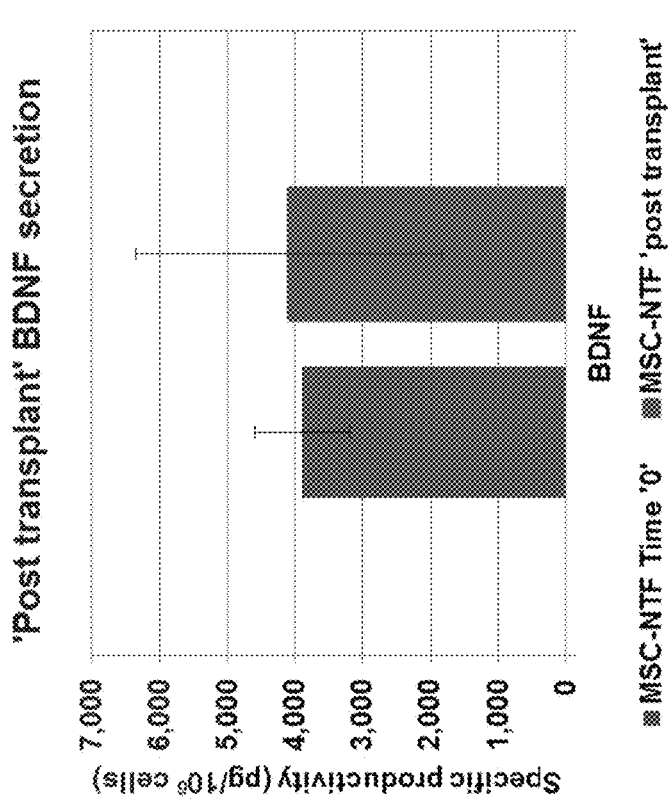
Figure 11B:
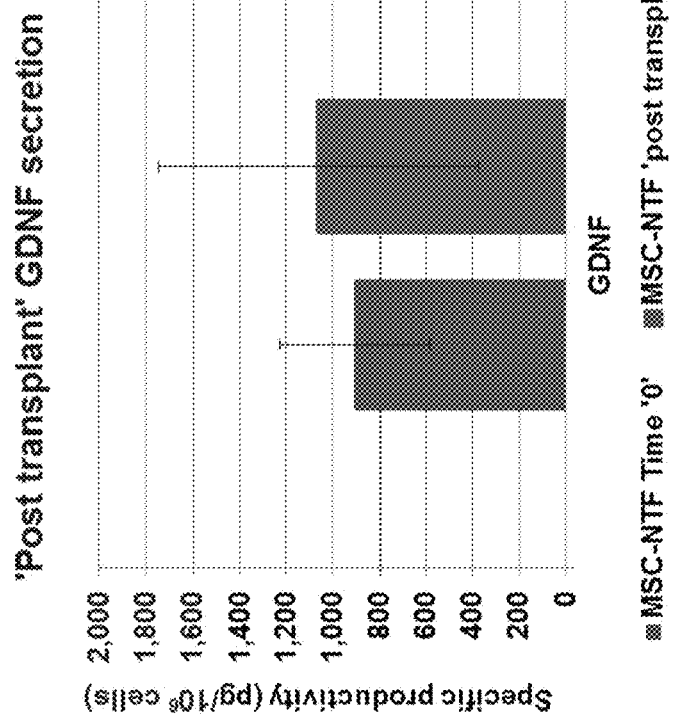

FIGS. 11A-B are graphs illustrating GDNF and BDNF production by MSC-NTF cells upon harvest (time '0') and three days following culture in growth medium 'transplantation' mimicking an 'in-vivo' environment. The results show the average±SD of 4 independent experiments with MSC-NTF cells of ALS patients.

Figure 12A:
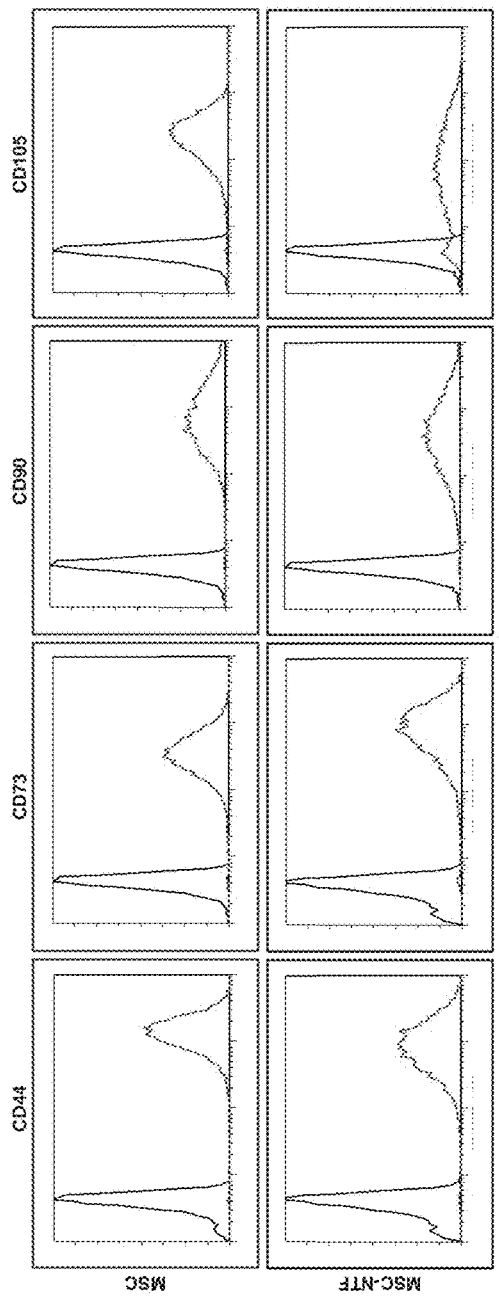
Figure 12B:
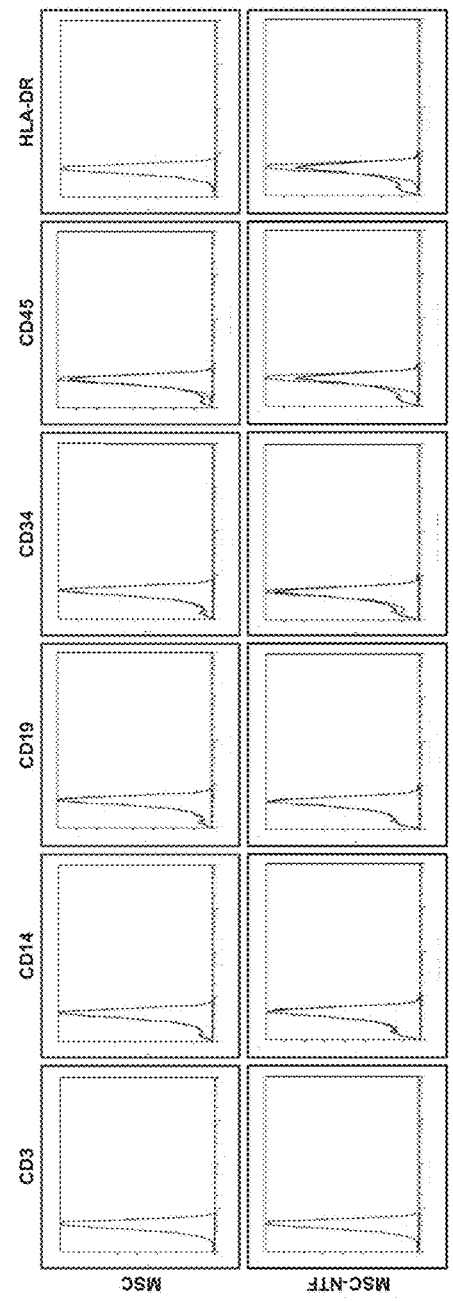

FIGS. 12A-B are the results of the phenotypic characterization of ALS patient MSC-NTF surface marker expression at the end of differentiation as compared to MSC of the same patient. The panel of MSC-characteristic surface markers analysed by flow cytometry included CD44, CD73, CD90, and CD105 positive markers (A) and CD3, CD14, CD19, CD34, CD45 and HLA-DR negative markers (B). The MSC and MSC-NTF cells are in red and the isotype control in black. ALS patient initials ZH).

FIGS. 13A-B are histograms illustrating flow cytometry analysis of CD44 and CD73 expression on the surface of MSC (black) and MSC-NTF (red) cells of the same patient at the end of differentiation. The dotted line to the left is the isotype control.

FIGS. 14A-B are graphs illustrating flow cytometry analysis of CD105 expression of MSC and MSC-NTF cells during differentiation. Flow cytometry analysis of CD105 expression on the surface of MSC (black) and MSC-NTF (red) cells of the same patient on days 2 and 3 of differentiation (n=16 and 22 respectively). The dotted line to the left is the isotype control.

FIGS. 15A-B are histograms illustrating cell cycle analyses of MSC and MSC-NTF secreting cells. The distribution of cells in the $G_0/G_1$, S and $G_2/M$ phases of the cell cycle is shown. The shift to $G_0/G_1$ is apparent in the MSC-NTF cell population.

Figure 16B:
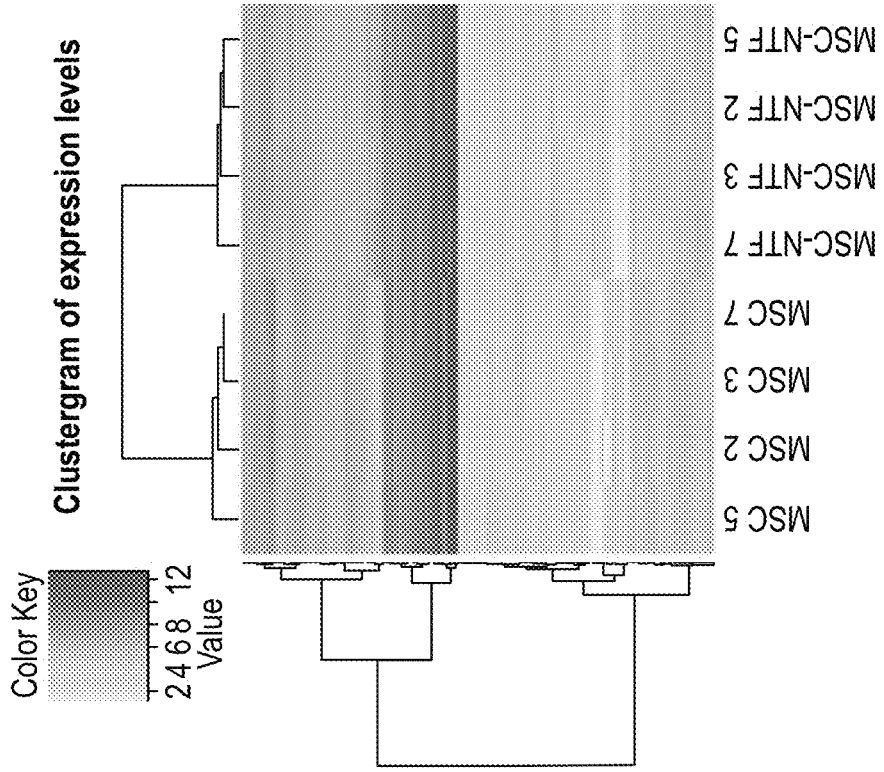
Figure 16A:
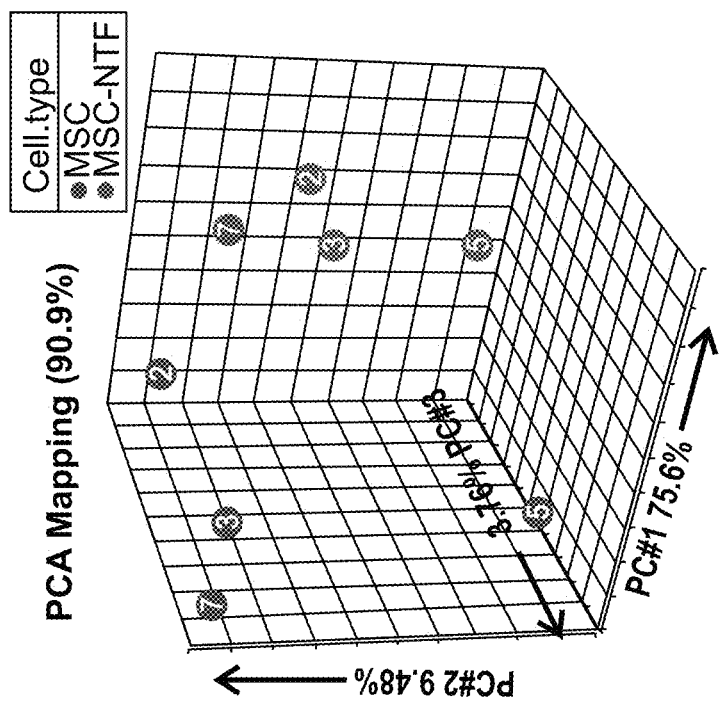

FIGS. 16A-B compare the two cell types based on all 160 detected miRNAs with cell type and donor ID indicated. A. Representation of the miRNA profiles of the 8 different cell samples in a 3D PCA projection, including donor ID; B Representation of the miRNA profiles of the 8 different cell samples as a heatmap clustergram plot after hierarchical clustering, including donor ID.

FIG. 17 is an expression profile of the 19 key miRNAs upregulated in MSC-NTF vs. MSC on a log 2 scale. The miRNAs strongly induced/most highly upregulated in MSC-NTFs are highlighted with red ovals. When the expression of miRNA was below the level of detection for the arrays, a nominal intensity value is given to these data points. This value is inserted to avoid errors arising from non-computable mathematical operations during subsequent data analyses. From the normalisation process, this then results in a normalised intensity value of 1.1375 for these miRNAs.

Figure 18:
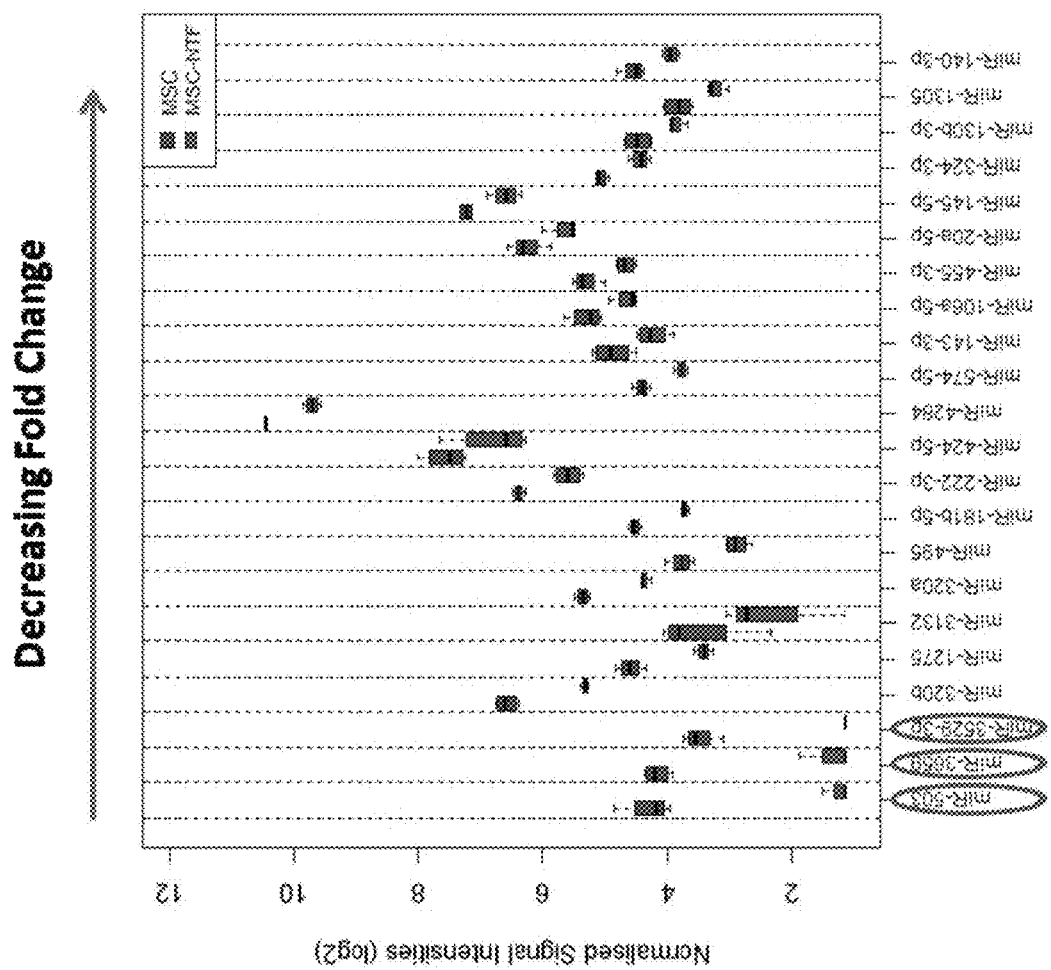

FIG. 18 is an expression profile of the 22 key miRNAs downregulated in MSC-NTF vs MSC on a log 2 scale. The miRNAs most highly downregulated in MSC-NTFs are highlighted with red ovals. When the expression of miRNA was below the level of detection for the arrays, a nominal intensity value is given to these data points. This value is inserted to avoid errors arising from non-computable mathematical operations during subsequent data analyses. From the normalization process, this then results in a normalised intensity value of 1.1375 for these miRNAs.

Figure 19:
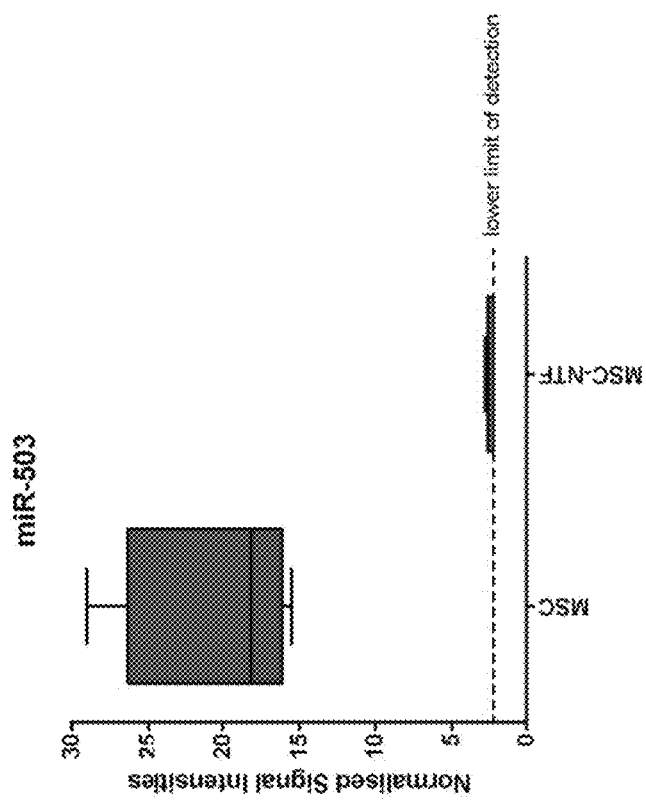

FIG. 19 is a bar graph illustrating that expression of miR-503 is downregulated in MSC-NTF vs MSC.

Figure 20:
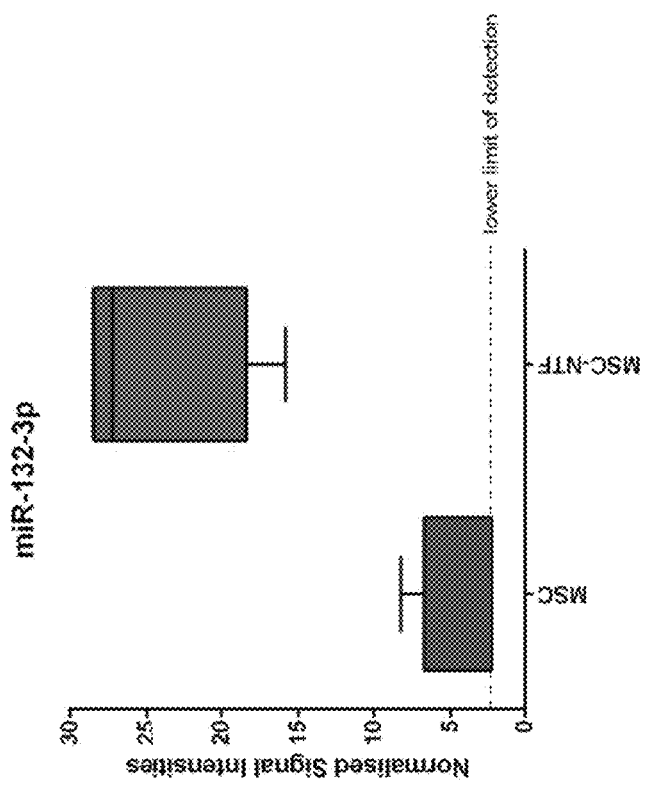

FIG. 20 is a bar graph illustrating that expression of miR132-3p is upregulated in MSC-NTF vs MSC.

Figure 21:
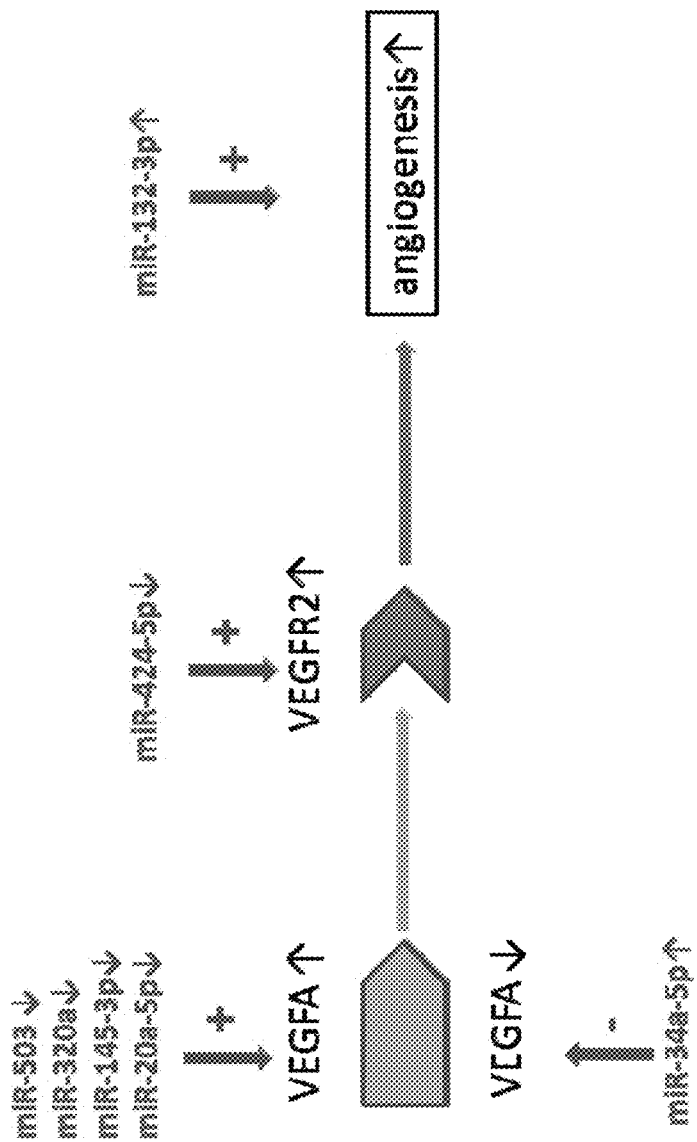

FIG. 21 is a scheme summarizing the differentially expressed miRNA profile in MSC-NTFs leading to predicted enhanced pro-angiogenic capacity of these cells.

Figure 22A:
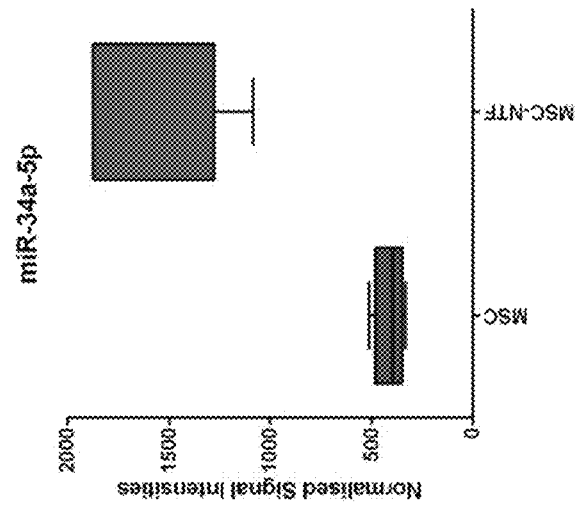
Figure 22B:
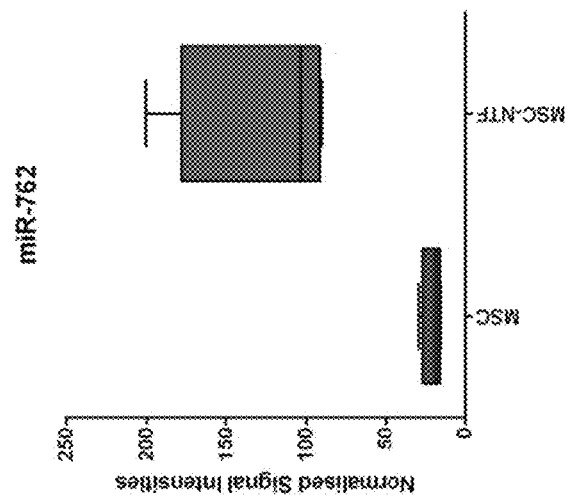
Figure 23A:
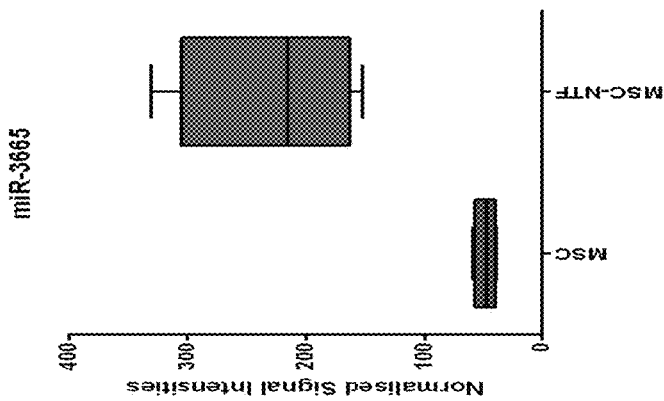
Figure 23B:
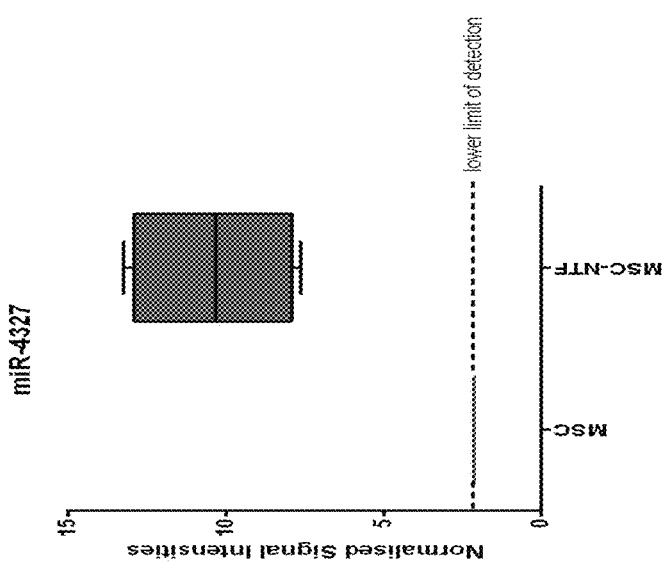
Figure 23C:
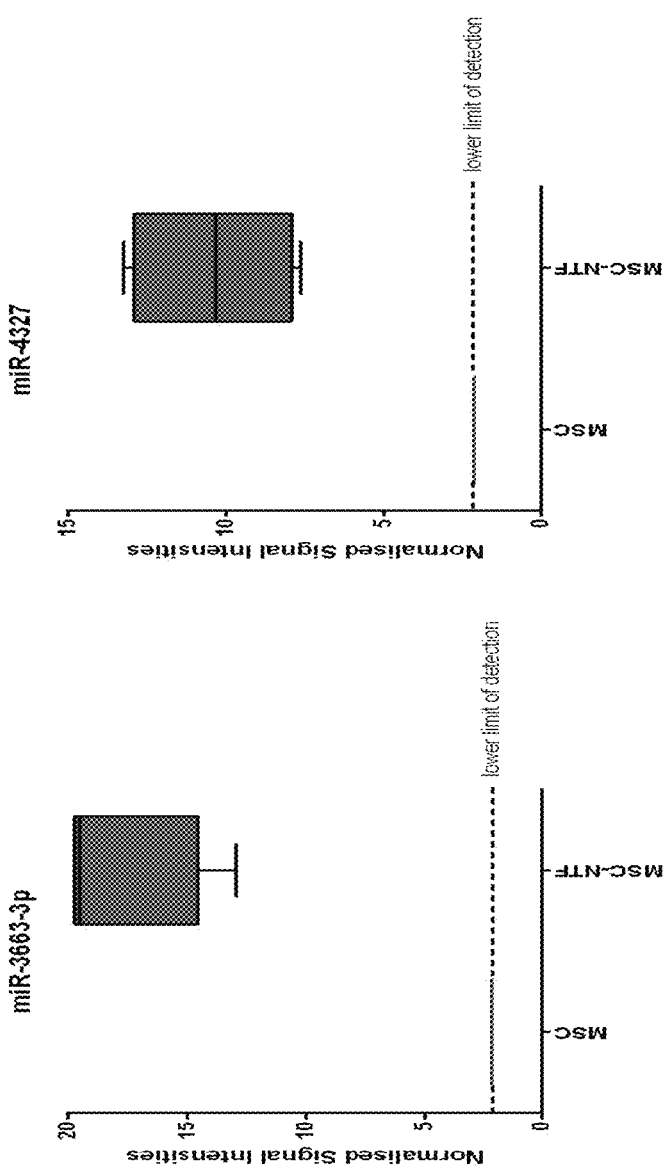
Figure 23E:
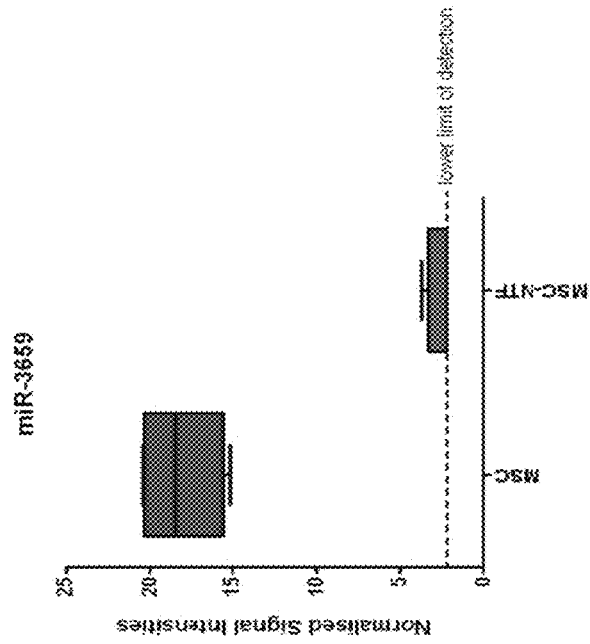
Figure 23D:
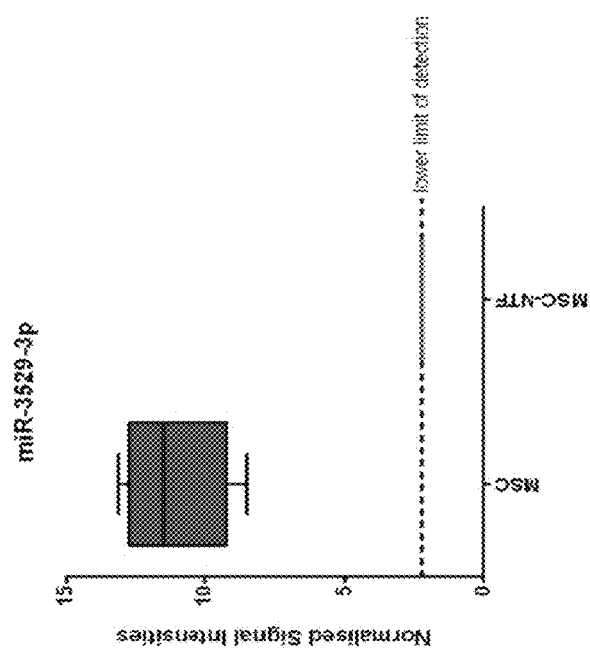

FIGS. 22A-B illustrate that the expression of miR-762 (A) and miR-34a-5p (B) are upregulated in MSC-NTF vs MSC. When the expression of miRNA was below the level of detection for the arrays, a nominal intensity value is given to these data points. This value is inserted to avoid errors arising from non-computable mathematical operations during subsequent data analyses. From the normalization process, this then results in a normalised intensity value of 2.2 for these miRNAs.

FIGS. 23A-E illustrate the expression profiles of highly-discriminatory miRNAs, with no validated mRNA targets that were DE in MSC-NTF vs MSC. When the expression of miRNA was below the level of detection for the arrays, a nominal intensity value is given to these data points. This value is inserted to avoid errors arising from non-computable mathematical operations during subsequent data analyses. From the normalization process, this then results in a normalized intensity value of 2.2 for these miRNAs on a linear scale.

Figure 24A:
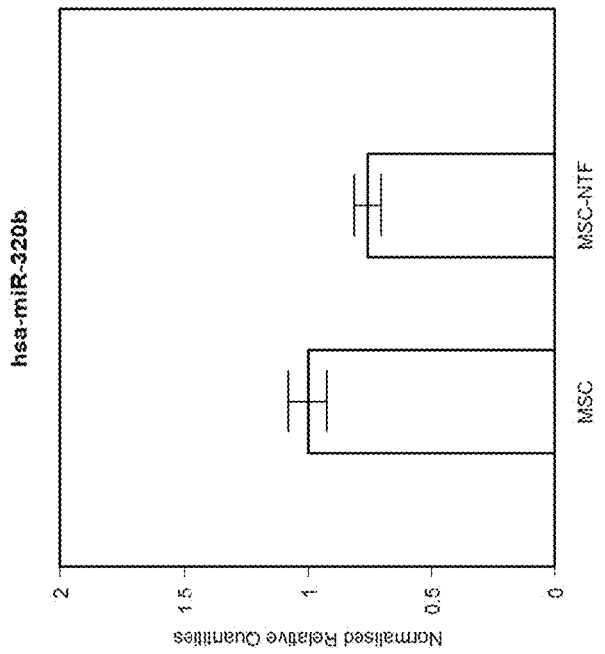
Figure 24B:
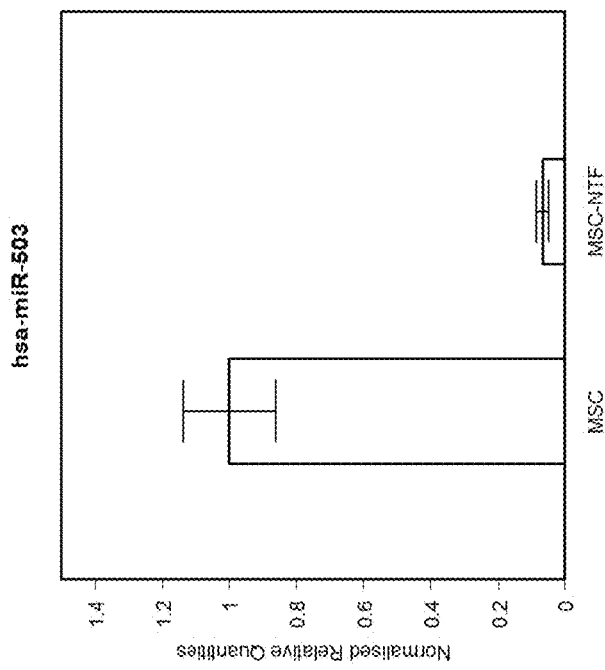
Figure 24C:
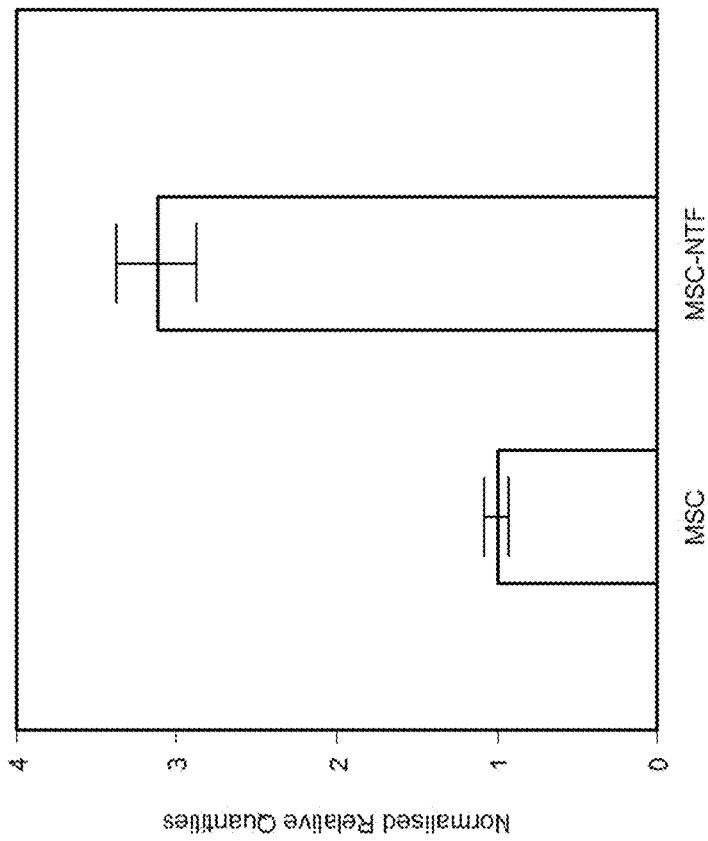
Figure 24D:
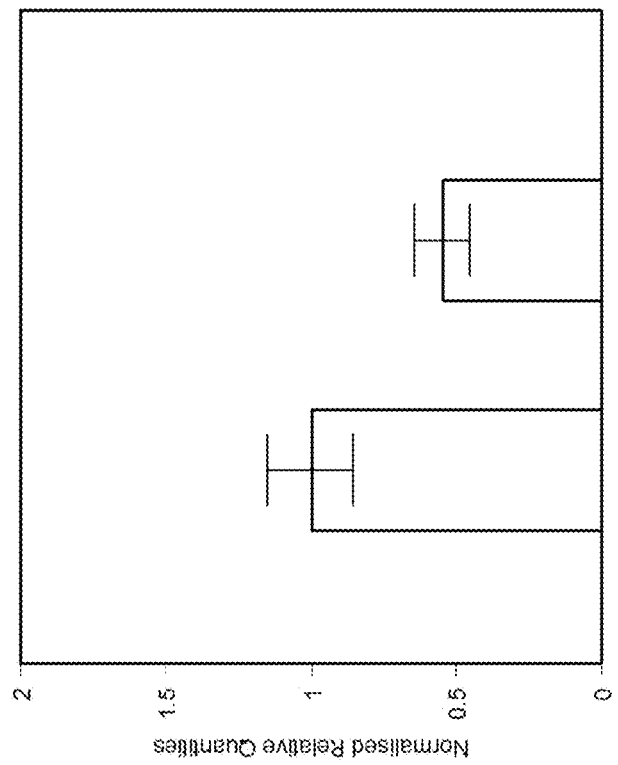
Figure 24E:
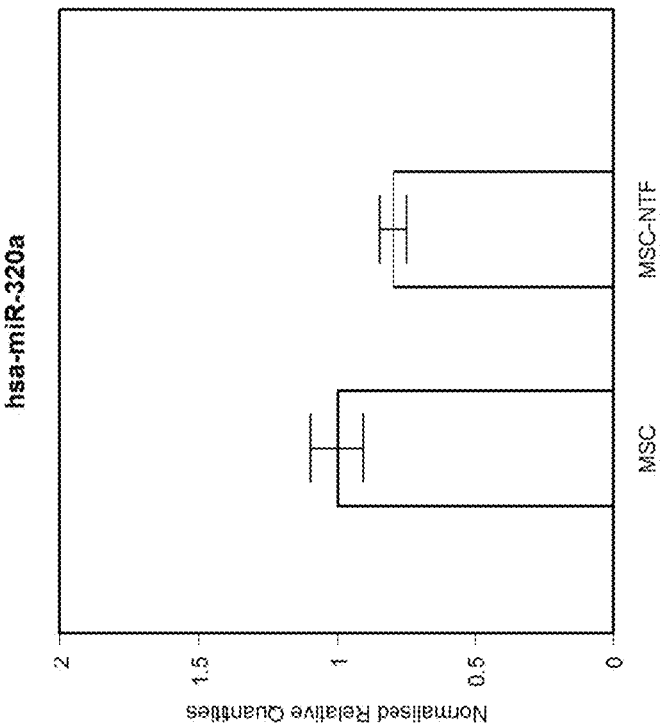
Figure 24F:
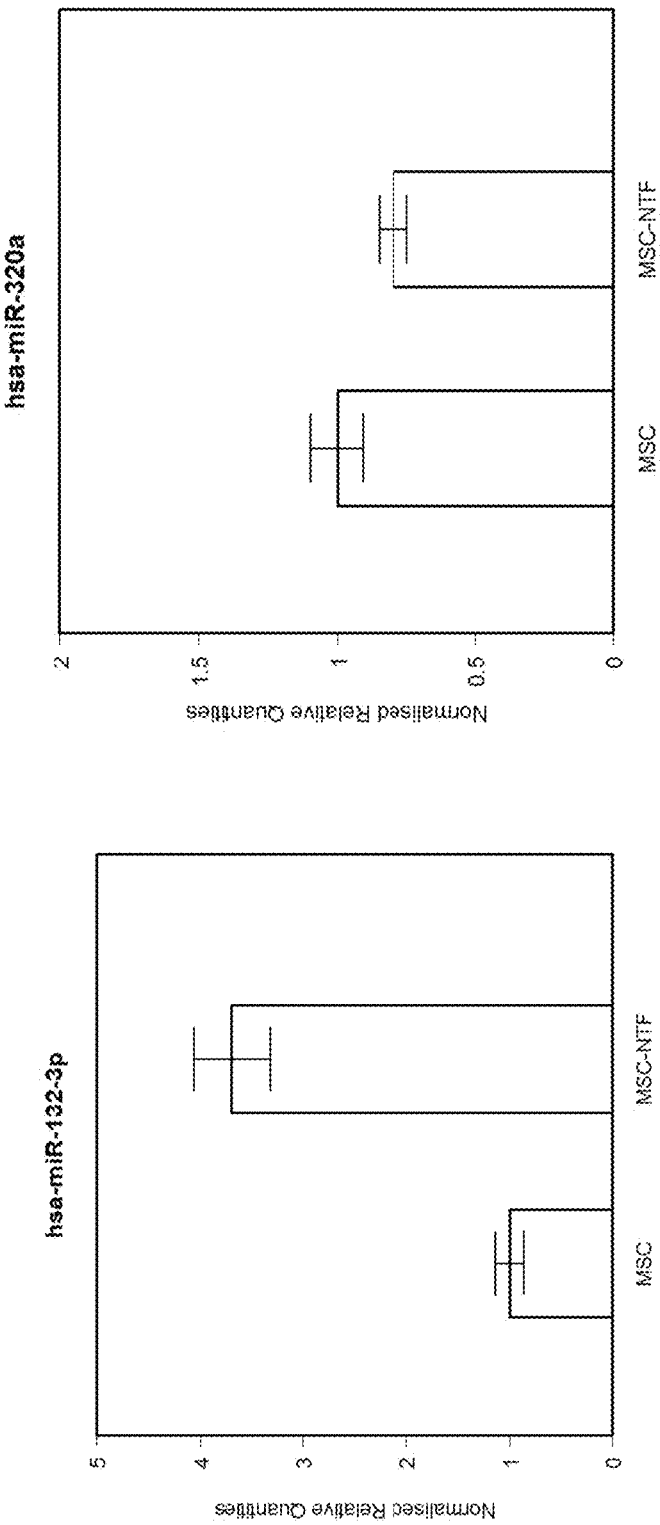
Figure 24G:
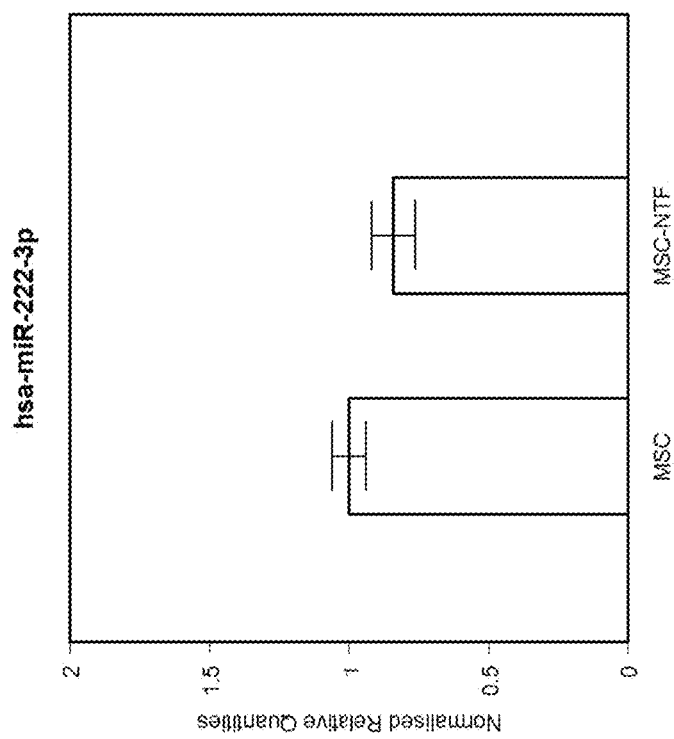

FIGS. 24A-G are bar graphs comparing the expression of particular miRNAs in MSC samples and MSC-NTF samples. FIG. 24A illustrates that hsa-miR-503 is down-regulated in MSC-NTFs as compared to MSCs. FIG. 24B illustrates that hsa-miR-320b is down-regulated in MSC-NTFs as compared to MSCs. FIG. 24C illustrates that hsa-miR-424-5p is down-regulated in MSC-NTFs as compared to MSCs. FIG. 24D illustrates that hsa-miR-34a-5p is up-regulated in MSC-NTFs as compared to MSCs. FIG. 24E illustrates that hsa-miR-132-3p is up-regulated in MSC-NTFs as compared to MSCs. FIG. 24F illustrates that hsa-miR-320a is non-significantly down-regulated in MSC-NTFs as compared to MSCs. FIG. 24G illustrates that miR-222-3p is non-significantly down-regulated in MSC-NTFs as compared to MSCs.

Figure 25:
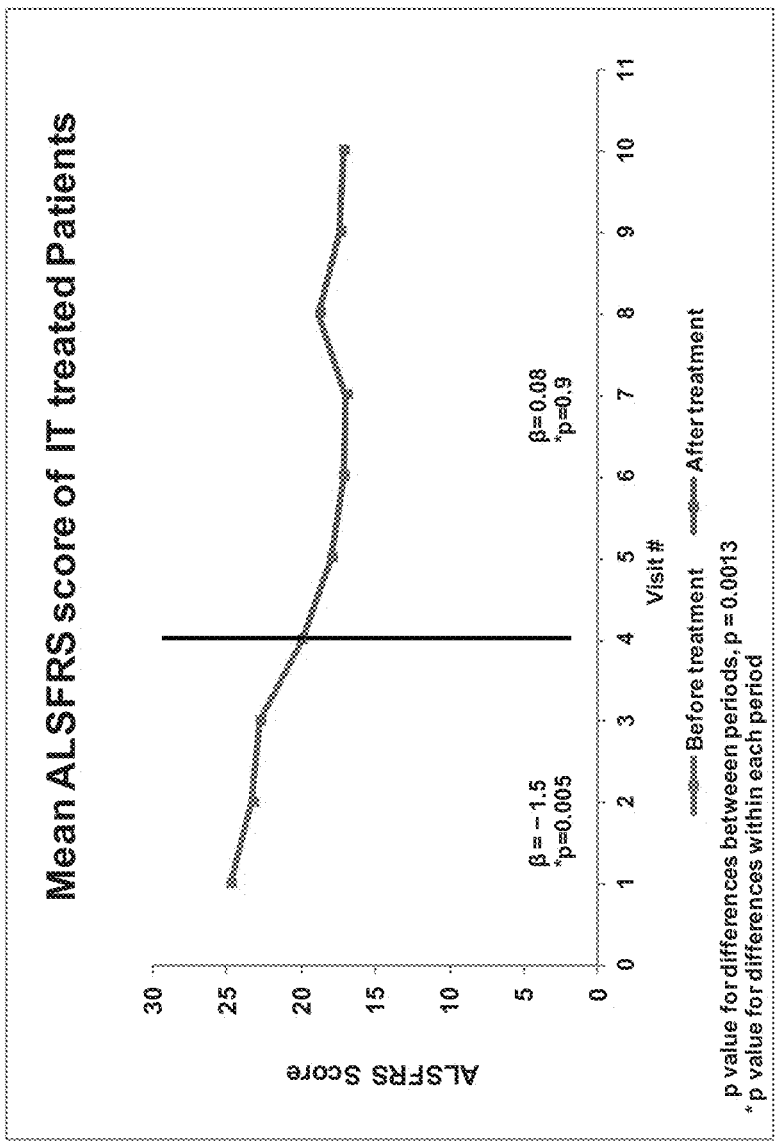

FIG. 25 is a graph illustrating the effect of IT administration of MSC-NTFs on the ALS Functional Rating Score (ALSFRS-R).

Figure 26:
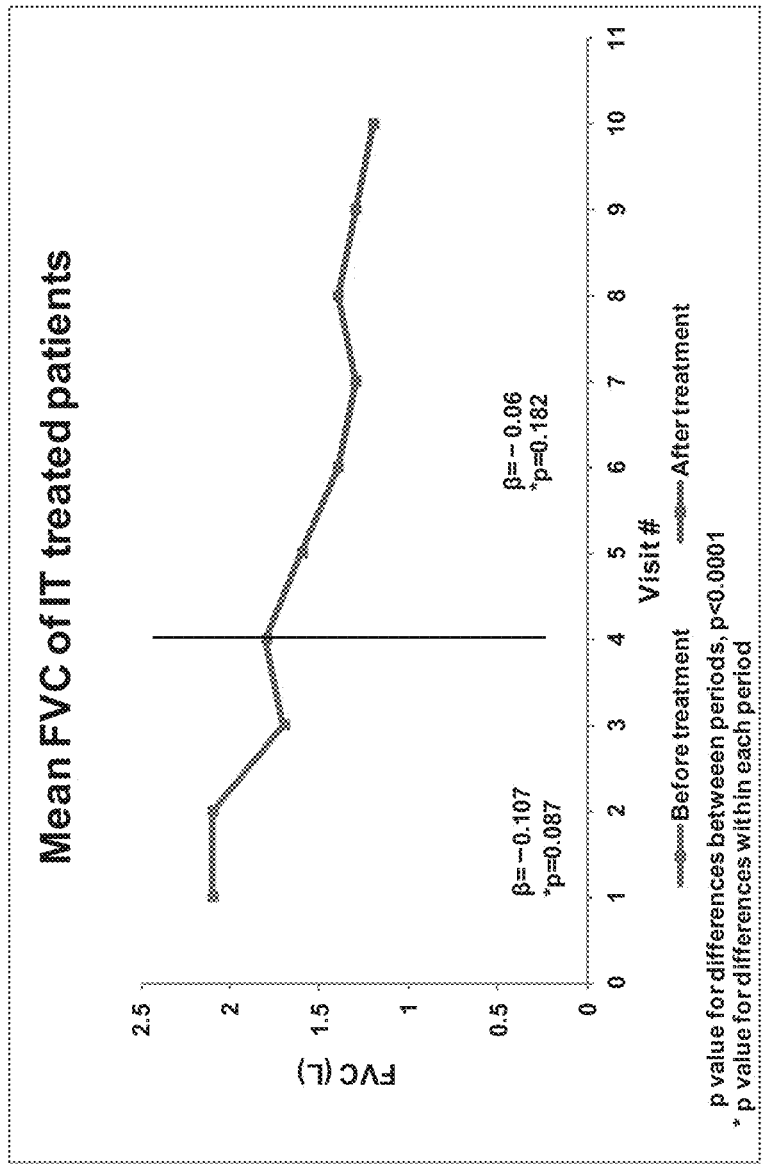

FIG. 26 is a graph illustrating the effect of IT administration of MSC-NTFs on forced vital capacity (FVC).

Figure 27:
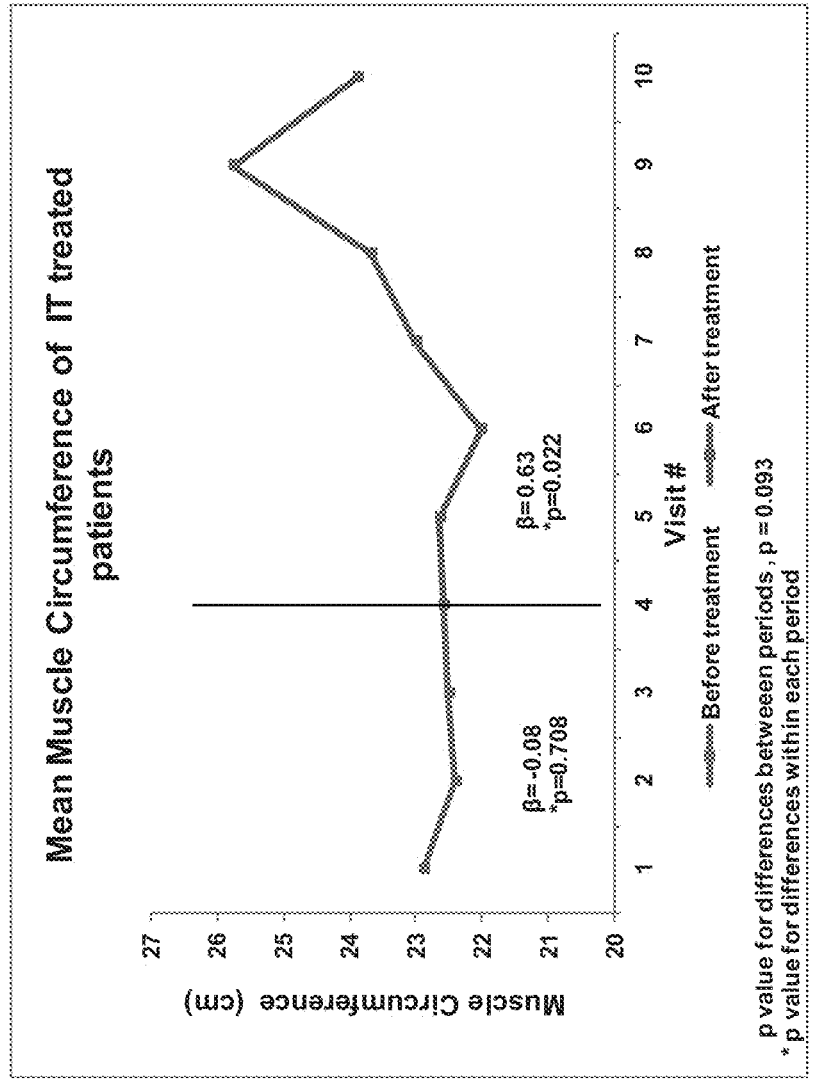

FIG. 27 is a graph illustrating the effect of IT administration of MSC-NTFs on mean muscle circumference.

Figure 28A:
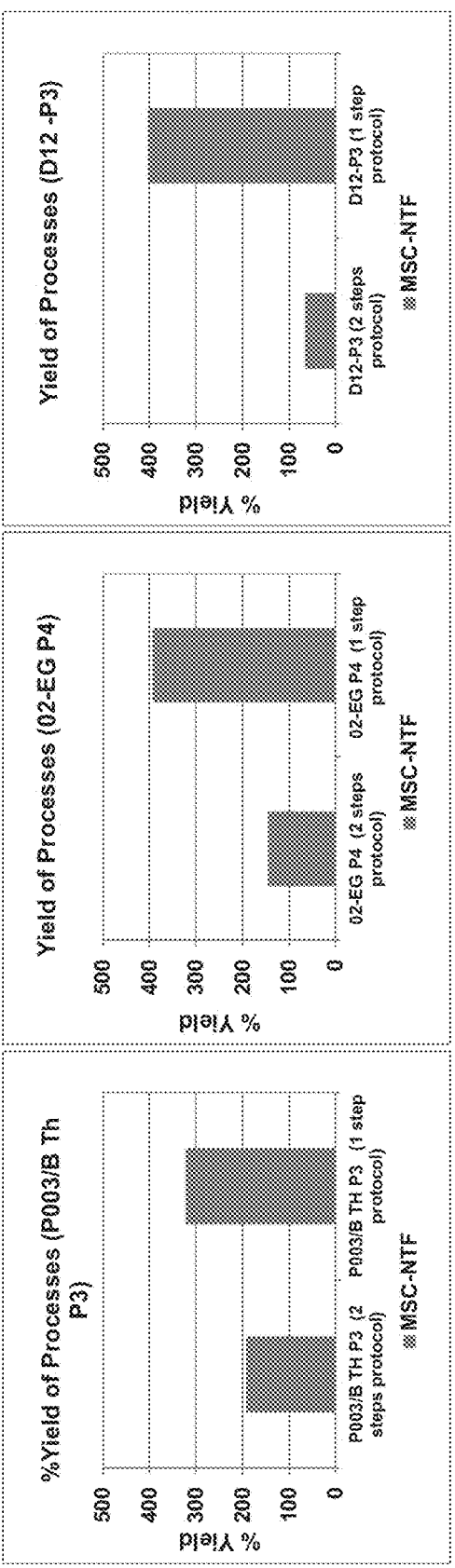
Figure 28B:
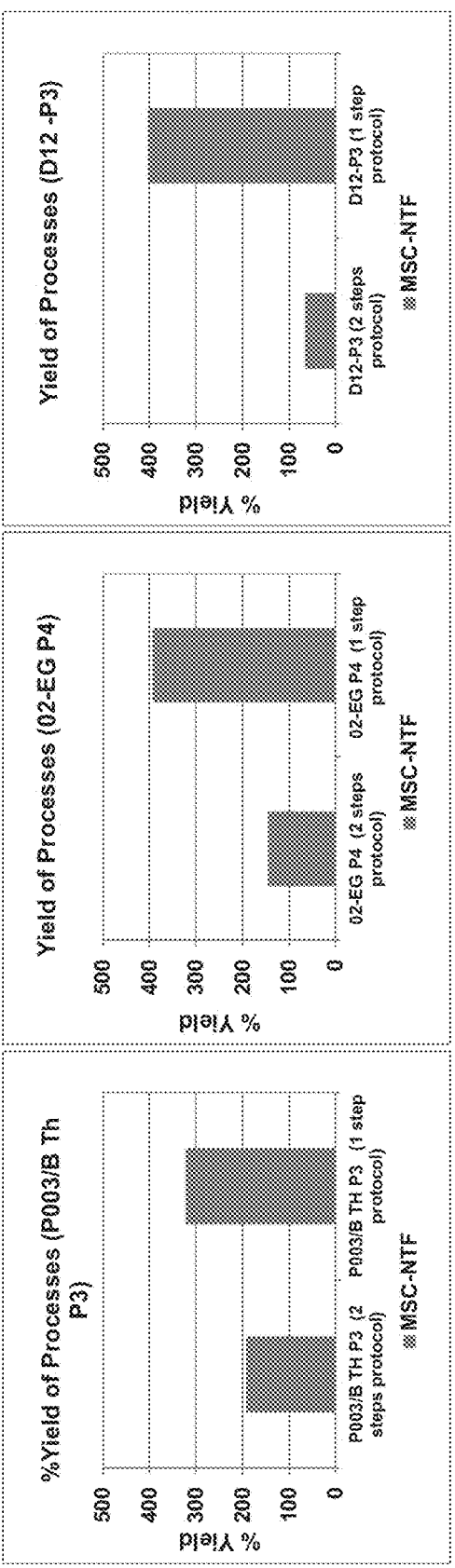
Figure 28C:
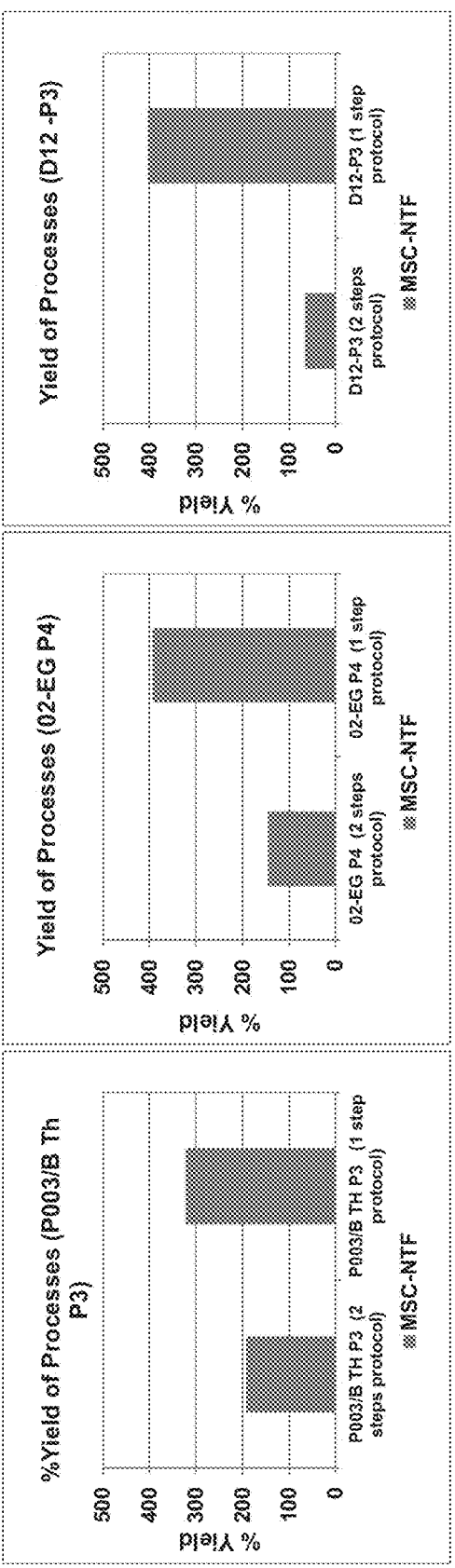

FIGS. 28A-C are bar graphs comparing the yield obtained using a two or one step differentiation protocol on three ALS patient samples.

DESCRIPTION OF SPECIFIC EMBODIMENTS OF THE INVENTION

The present invention, in some embodiments thereof, relates to methods of generating cells from mesenchymal stem cells that secrete neurotrophic factors and, methods of selecting same.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

Neurotrophic factors (NTFs) are secreted proteins that regulate the survival, functional maintenance and phenotypic development of neuronal cells. Alterations in NTF levels are involved in triggering programmed cell-death in neurons and thus contribute to the pathogenesis of Parkinson's disease and other neurodegenerative diseases.

However, the direct use of neurotrophic factors is not applicable as they do not pass the blood-brain bather and do not distribute properly following systemic injection. Therefore, other strategies must be developed in order to take advantage of their therapeutic properties.

Protocols for differentiating human mesenchymal stem cells into neurotrophic factor secreting cells are known in the art—see for example WO 2006/134602 and WO 2009/144718.

The present inventors have developed new methods which enhance the secretion of neurotrophic factors from mesenchymal stem cells (MSCs). The method comprises for the first time direct differentiation of undifferentiated MSCs in a single medium comprising basic fibroblast growth factor (bFGF), platelet derived growth factor (PDGF), heregulin and cAMP. The level of secretion of glial derived growth factor (GDNF) and brain derived neurotrophic factor (BDNF) was shown to be consistently upregulated following the differentiation process, with GDNF being upregulated by as much as 20 fold and BDNF by as much as three fold as compared to the corresponding non-differentiated cell population, as exemplified in FIGS. 7 and 8.

The present inventors have characterized these unique cells by surface marker expression as illustrated in FIGS. 12A-B.

Thus, according to one aspect of the present invention there is provided a method of generating cells which secrete NTFs comprising incubating a population of undifferentiated MSCs in a differentiating medium comprising basic fibroblast growth factor (bFGF), platelet derived growth factor (PDGF), heregulin and cAMP.

The term "mesenchymal stem cell" or "MSC" is used interchangeably for adult cells which are not terminally differentiated, which can divide to yield cells that are either stem cells, or which, irreversibly differentiate to give rise to cells of a mesenchymal (chrondocyte, osteocyte and adipocyte) cell lineage. The mesenchymal stem cells of the present invention, in at least some embodiments, may be of a syngeneic or allogeneic source.

Populations of MSCs typically express particular markers on their cell surface. According to a particular embodiment, the undifferentiated MSCs express CD105, CD73 and CD90 on the cell surface (e.g. >95% positive) and lack expression (e.g. <2% positive) of CD3, CD14, CD19, CD34, CD45, and HLA-DR as determined by flow cytometry.

Exemplary antibodies that may be used to verify the presence of mesenchymal stem cells include CD44 FITC conjugated, BD Biosciences, CD73 PE conjugated (BD Pharmingen), CD73 PE conjugated, BD Biosciences, CD90 PE-Cy5 conjugated (eBioscience) CD90 PE conjugated, BD Biosciences CD105 PE conjugated (Beckman Coulter) CD3 PerCP conjugated, BD Biosciences, CD14 FITC conjugated (eBioscience) CD14 FITC conjugated, BD Biosciences CD19 PE-Cy5 conjugated (eBioscience) CD19 FITC conjugated, BD Biosciences CD34 FITC conjugated BD Biosciences (Beckman Coulter), CD45 PE conjugated (eBioscience) CD45 PerCP conjugated, BD Biosciences and HLA-DR PE-Cy5 conjugated (BD Pharmingen). HLA-DR PerCP conjugated, BD Biosciences.

Another method for verifying the presence of mesenchymal stem cells is by showing that the cells are capable of differentiating into multi-lineages such as for example adipocytes, osteocytes and chondrocytes. This may be effected for example using Human Mesenchymal Stem Cell Functional Identification Kit (R&D Systems).

According to a preferred embodiment of this aspect of the present invention the mesenchymal stem cells are not genetically manipulated (i.e. transformed with an expression construct) to generate the cells and cell populations described herein.

It will be appreciated that the cells of the present invention, in at least some embodiments, may be derived from any stem cell, although preferably not embryonic stem (ES) cells.

Mesenchymal stem cells may be isolated from various tissues including but not limited to bone marrow, peripheral blood, blood, placenta and adipose tissue. A method of isolating mesenchymal stem cells from peripheral blood is described by Kassis et al [Bone Marrow Transplant. 2006 May; 37(10):967-76]. A method of isolating mesenchymal stem cells from placental tissue is described by Brooke G et al. [Br J Haematol. 2009 February; 144(4):571-9].

Methods of isolating and culturing adipose tissue, placental and cord blood mesenchymal stem cells are described by Kern et al [Stem Cells, 2006; 24:1294-1301].

According to a preferred embodiment of this aspect of the present invention, the mesenchymal stem cells are human.

Bone marrow can be isolated from the iliac crest or the sternum of an individual by aspiration. Low-density BM mononuclear cells (BMMNC) may be separated by FICOLL-PAQUE density gradient centrifugation. In order to obtain mesenchymal stem cells, a cell population comprising the mesenchymal stem cells (e.g. BMMNC) may be cultured in a proliferating medium capable of maintaining and/or expanding the cells in the presence of platelet lysate. According to one embodiment the populations are plated on plastic surfaces (e.g. in a flask) and mesenchymal stem cells are isolated by removing non-adherent cells. Alternatively mesenchymal stem cell may be isolated by FACS using mesenchymal stem cell markers.

Following isolation the cells are typically expanded by culturing in a proliferation medium capable of maintaining and/or expanding the isolated cells ex vivo in the presence of platelet lysate. The proliferation medium may be DMEM, alpha-MEM or DMEM/F12. Typically, the glucose concentration in the medium is about 0.5-3 grams/liter. The culturing may be effected on any suitable surface including plastic dishes and bioreactors suitable for culturing mesenchymal stem cells.

Platelet lysate may be prepared using any method known in the art. Platelet Rich Plasma (PRP) may be derived from blood bank donations determined free of infectious agents (i.e. HIV, HTLV, HCV, HBsAg). PRP containing bags may be stored at −80° C. and thawed in a 37° C. water bath. After thawing, the Platelet Rich Plasma is typically centrifuged to remove platelet particles and membranes. The Platelet lysate supernatant may then be collected and frozen at −80° C. until use. The Platelet lysate is tested for Endotoxin, Haemoglobin, pH, Total protein, Albumin, Osmolality Sterility and *Mycoplasma*.

The proliferation medium may comprise additional components, including for example L-glutamine, sodium pyruvate and heparin.

It will be appreciated that preferably when the mesenchymal stem cells are human, the platelet lysate is also obtained from human cells.

According to one embodiment, the proliferation/growth medium is devoid of xeno contaminants i.e. free of animal derived components such as serum, animal derived growth factors and albumin Thus, according to this embodiment, the culturing is performed in the absence of xeno contaminants.

An exemplary mesenchymal stem cell isolation and propagation protocol is presented in the Examples section, herein below.

As mentioned, following propagation of mesenchymal stem cells in a platelet lysate containing medium, and an adequate number of undifferentiated cells are obtained, the cells may be differentiated in a differentiating medium to generating cells useful for treating diseases.

According to a particular embodiment, the cells are reseeded in a fresh proliferation/growth medium (e.g. at a density of about 6000-8000 cells per cm²) for 1 day, 2 days, 3 days, 4 days or 5 days prior to addition of the differentiation medium.

The phrase "undifferentiated MSCs" refers to MSCs that have not been cultured in a medium that induces differentiation. Thus, according to at least some embodiments of the present invention, following proliferation, the MSCs are contacted directly with the differentiation medium without any intervening pre-differentiation steps.

For differentiation, the undifferentiated MSCs of the present invention, in at least some embodiments are incubated in a medium comprising fibroblast growth factor (FGF), platelet derived growth factor (PDGF), heregulin and c-AMP. According to this embodiment each of fibroblast growth factor (FGF), platelet derived growth factor (PDGF), heregulin and c-AMP are mixed in a single medium and the culturing is effected in a single step.

According to one embodiment, the undifferentiated MSCs of the present invention are not pre-incubated in the presence of epidermal growth factor (EGF) and/or N2 supplement prior to this step and following the expansion step.

An exemplary concentration of bFGF which is contemplated for the differentiation medium of embodiments of this invention is optionally between 5-50 ng/ml, optionally between 10-40 ng/ml, optionally between 10-25 ng/ml.

An exemplary concentration of PDGF-AA which is contemplated for the differentiation medium of embodiments of this invention is optionally between 1-30 ng/ml, optionally between 1-20 ng/ml, optionally between 1-10 ng/ml, optionally between 2.5-10 ng/ml.

An exemplary concentration of heregulin β1 which is contemplated for the differentiation medium of embodiments of this invention is optionally between 5-100 ng/ml, 10-90 ng/ml, optionally between 25-75 ng/ml and optionally between 40-60 ng/ml.

An exemplary concentration of dbc-AMP which is contemplated for the differentiation medium of embodiments of this invention is optionally between 0.5-10 mM, optionally between 0.5-5 mM and optionally between 0.5 and 2.5 mM.

According to one embodiment, the differentiating medium of this aspect of the present invention is devoid of a phosphodiesterase inhibitor (e.g. IBMX) i.e. the culturing is performed in the absence of a phosphodiesterase inhibitor.

According to another embodiment, the differentiating medium of this aspect of the present invention is devoid of triiodothyronine i.e. the culturing is performed in the absence of triiodothyronine.

Optionally, any of these embodiments and subembodiments may be combined, so that for example the differentiating medium may optionally be devoid of both a phosphodiesterase inhibitor and triiodothyronine.

Preferably, the MSCs are differentiated in the above described differentiating medium for at least one day, at least two days or at least 3 days. Preferably, the differentiating stage is not performed for more than five days.

The differentiating media used according to this aspect of the present invention are preferably xeno-free (devoid of serum) and devoid of any antibiotics i.e. the culturing is performed in the absence of xeno-contaminants.

According to an embodiment, the cells are produced in industrial amounts sufficient to be used in the treatment regimens described herein below.

Thus, for example, from one donor, it is envisaged that at least $20 \times 10^6$ cells are produced, more preferably at least $50 \times 10^6$ cells are produced, more preferably at least $110 \times 10^6$ cells are produced, more preferably at least $200 \times 10^6$ cells are produced, more preferably at least $330 \times 10^6$ cells are produced, more preferably at least $500 \times 10^6$ cells are produced, more preferably at least $20 \times 10^6$ cells are produced, more preferably at least $600 \times 10^6$ cells are produced, more preferably at least $700 \times 10^6$ cells are produced, more preferably at least $800 \times 10^6$ cells are produced, more preferably at least $900 \times 10^6$ cells are produced, more preferably at least $100 \times 10^7$ cells are produced.

The present invention further envisages storing the differentiated stem cells in banks.

Each aliquot of differentiated stem cells may correspond to a particular donor. Alternatively, differentiated stem cells from more than one donor may be pooled and stored in a single aliquot. The bank may also contain one or more samples of the human feeder cells and/or platelet lysate used to expand and/or differentiate the MSC populations.

The MSC populations are stored under appropriate conditions (typically by freezing) to keep the stem cells alive and functioning. According to one embodiment, the MSC populations are stored as cryopreserved populations. Other preservation methods are described in U.S. Pat. Nos. 5,656,498, 5,004,681, 5,192,553, 5,955,257, and 6,461,645. Methods for banking stem cells are described, for example, in U.S. Patent Application Publication No. 2003/0215942.

According to one embodiment, the cell populations stored in the bank are characterized according to at least one predetermined characteristic—e.g. amount of neurotrophic factor which is secreted Additional predetermined characteristics include for example morphological characteristics, differentiation profile, blood type, major histocompatibility complex, disease state of donor, or genotypic information (e.g. single nucleated polymorphisms, 'SNPs' of a specific nucleic acid sequence associated with a gene, or genomic or mitochondrial DNA) associated or not associated with the disease.

Cataloguing may constitute creating a centralized record of the characteristics obtained for each cell population, such as, but not limited to, an assembled written record or a computer database with information inputted therein. The stem cell bank facilitates the selection from a plurality of samples of a specific mesenchymal stem cell sample suitable for a researcher's or clinician's needs.

According to one embodiment, the mesenchymal stem cell bank described herein is maintained by a stem cell database computer unit. Each computer unit comprises at least one processing module, respectively, for processing information. The computer unit may be communicatingly connected to a display. Information directed to mesenchymal stem cell populations may be stored on a database computer which is conveyed to users via a network connection. Such a system provides the customer the ability to evaluate the mesenchymal stem cell populations to determine which are suitable for their ongoing research and use and may also serve to facilitate the transaction of purchasing stem cells and proper shipment.

As will be appreciated by one of skill in the art, embodiments of the present invention may be embodied as a device or system comprising a processing module, and/or computer program product comprising at least one program code module. Accordingly, the present invention may take the form of an entirely hardware embodiment or an embodiment combining software and hardware aspects. Furthermore, the present invention may include a computer program product on a computer-usable storage medium having computer-usable program code means embodied in the medium. Any suitable computer readable medium may be utilized including hard disks, CD-ROMs, DVDs, optical storage devices, or magnetic storage devices.

As mentioned, the cells generated according to embodiments of this method secrete several neurotrophic factors.

As used herein, the phrase "neurotrophic factor" refers to a cell factor that acts on the central nervous system comprising growth, differentiation, functional maintenance and/or survival effects on neurons. Examples of neurotrophic factors include, but are not limited to, glial derived neurotrophic factor (GDNF), GenBank accession nos. L19063, L15306; brain-derived neurotrophic factor (BDNF), GenBank accession no CAA62632; neurotrophin-3 (NT-3); neurotrophin-4/5; Neurturin (NTN), GenBank Accession No. NP_004549; Neurotrophin-4, GenBank Accession No. M86528; Persephin, GenBank accession no. AAC39640; brain derived neurotrophic factor, (BDNF), GenBank accession no. CAA42761; artemin (ART), GenBank accession no. AAD13110; ciliary neurotrophic factor (CNTF), GenBank accession no. NP_000605; and Neublastin GenBank accession no. AAD21075.

According to another embodiment, the cells generated according to embodiments of the present invention secrete Hepatocyte Growth Factor (HGF; Genbank Accession No. D90334.2) According to one embodiment, the cells secrete at least 2 times, at least 3 times, at least 4 times, at least 5 times or even at least 6 times the amount of HGF as non-differentiated MSCs. The control non-differentiated MSCs are preferably from the same source (e.g. same donor, same organ) as those used generate the cells which secrete the neurotrophic factors.

According to another embodiment, the cells generated according to embodiments of the present invention secrete Vascular endothelial growth factor (VEGF). According to one embodiment, the cells secrete at least 2 times, at least 3 times, at least 4 times, at least 5 times or even at least 6 times the amount of HGF as non-differentiated MSCs. The control non-differentiated MSCs are preferably from the same source (e.g. same donor, same organ) as those used to generate the cells which secrete the neurotrophic factors.

According to another embodiment, the cells generated according to embodiments of the present invention do not secrete Tumor Necrosis Factor-inducible Gene 6 protein (TSG-6, Genbank Accession No. AJ421518.1 Gene ID: 7130).

According to another embodiment, the cells generated according to embodiments of the present invention do not secrete nerve growth factor (NGF, Genbank Accession No. M57399.1).

According to another embodiment, the cells generated according to embodiments of the present invention do not secrete insulin growth factor-I (IGF-I)—GenBank accession no. NP_000609.

According to one embodiment, at least at least 70%, at least 80%, at least 90% or more of a population of the differentiated cells of the present invention secrete GDNF.

Preferably, the amount of GDNF secreted by the cells of the present invention is increased by at least 2 fold, at least 3 fold, at least 4 fold, at least 5 fold, at least 6 fold, at least 7 fold, at least 8 fold the secretion of the same population of mesenchymal stem cells without differentiation.

A typical concentration of GDNF is from about 200-2000 pg/$10^6$ cells.

According to one embodiment, at least 50%, at least 60%, at least 70%, at least 80%, at least 90% or more of a population of the differentiated cells of the present invention secrete BDNF.

Preferably, the amount of BDNF secreted by the cells of the present invention is increased by at least 1.5 fold, at least 2 fold, at least 2.5 fold, at least 3 fold the secretion of the same population of mesenchymal stem cells without differentiation.

A typical concentration of BDNF is from about 500-5000 pg/$10^6$ cells.

Once differentiated and optionally isolated, the cells may be tested (in culture) for their ability to secrete NTFs. For analysis of secreted NTFs, supernatant is collected from cultures of MSCs or of NTF-secreting cells at the end of the differentiation procedure described above, and cells are harvested and counted. The cells may also be analysed during the differentiation procedure, e.g. after 1 day of differentiation or after two days of differentiation). The amount of NTFs such as Glial Derived Neurotrophic Factor, (GDNF) or Brain Derived Neurotrophic Factor (BDNF) in the cell's culture supernatants may be quantified by using a GDNF or BDNF ELISA assay (GDNF DuoSet DY212; BDNF DuoSet DY248; R&D Systems) according to the manufacturer's protocol, for example and without limitation. The amount of IGF-1 can be quantified using an IGF ELISA assay (IGF-1 DuoSet Cat No. DY291; R&D System), for example and without limitation.

The amount of VEGF can be quantified using an VEGF ELISA assay (VEGF DuoSet R&D systems, Cat: DY293B) for example and without limitation. The amount of HGF can be quantified using an HGF ELISA assay (HGF DuoSet R&D systems, Cat: DY294) for example and without limitation.

The neurotrophic factor secreting cells may express enhanced levels (e.g. at least two fold, or even at least three fold) of Integrin alpha 1 as compared to non-differentiated MSCs.

In addition, the neurotrophic factor secreting cells may express enhanced levels (e.g. at least two fold, or even at least three fold) of TGF beta, stem cell factor (SCF), macrophage colony stimulating factor (M-CSF), IL-6, IL-8, IL-10, IL-12, IFN-γ, and/or prostaglandin $E_2$ ($PGE_2$) as compared to non-differentiated MSCs.

According to yet another embodiment, the neurotrophic factor secreting cells do not express enhanced levels of oligodendrocyte markers such as PDGF-receptor, 04 sulfatide marker, galactocerebrosides (O1, GalC), Nkx2.2, Sox10, oligodendrocyte specific protein (OSP), myelin-associated glycoprotein (MAG), 2',3'-cyclic nucleotide-3'-phosphodiesterase (CNP), glutathione-S-transferase (GST), adenomatous polyposis coli (APC); myelin oligodendrocyte glycoprotein (MOG), CNPase, MOSP and/or Oligodendrocyte NS-1, as compared to non-differentiated MSCs.

According to yet another embodiment, the neurotrophic factor secreting cells do not express enhanced levels of neurotransmitters as compared to non-differentiated MSCs. Examples of neurotransmitters that are not expressed in the cells include dopamine, noradrenaline and serotonin.

It will be appreciated that the cells of the present invention, in at least some embodiments, are ex vivo differentiated from mesenchymal stem cells. As such they still express markers of mesenchymal stem cells such as CD29, CD47, MSCA-1, CD44, CD90, CD73, and CD105, as detected by flow cytometry.

Similarly to MSCs, the cells of the present invention, in at least some embodiments do not express the surface markers CD3, CD14, CD19, CD34, CD45 and HLA-DR, as detected by flow cytometry.

It will further be appreciated that although the cells described herein retain certain characteristics of MSCs, they are different from MSCs in a number of ways including for example, secretion of neurotrophic factors and expression of particular miRNAs and proteins.

Thus, for example, the present inventors have shown that particular cell surface markers are differentially expressed on the differentiated NTF secreting cells as opposed to the non-differentiated MSCs.

Surface markers which are differentially expressed by the differentiated mesenchymal stem cells include for example CD44 which is downregulated in the differentiated cells and CD73 which is upregulated in the differentiated cells as determined by the mean fluorescence intensity. For example according to at least some embodiments, the mean fluorescence intensity of the CD44 positive population is lower in differentiated cells as compared to non-differentiated cells— optionally at least 5% lower, optionally and preferably at least 10% lower, optionally and more preferably at least 15%, optionally at least 20%, 25% 30% or 40% or even 50% lower. Also for example, according to at least some embodiments, the mean fluorescence intensity of the CD73 positive population is higher in differentiated cells as compared to non-differentiated cells—optionally at least 5% higher, optionally and preferably at least 10% higher, optionally and more preferably at least 15%, optionally and most preferably at least 20%, 25%, 30% or 40% or even 50% higher.

miRNAs which are upregulated in the differentiated MSCs as compared to the non-differentiated MSCs include for example:
miR-3663-3p (SEQ ID NO: 1)
miR-132-3p (SEQ ID NO: 2)
miR-762 (SEQ ID NO: 3)
miR-4327 (SEQ ID NO: 4)
miR-3665 (SEQ ID NO: 5)
miR-34a-5p (SEQ ID NO: 6)
miR-1915-3p (SEQ ID NO: 7)
miR-34a-3p (SEQ ID NO: 8)
miR-34b-5p (SEQ ID NO: 9)
miR-874-3p (SEQ ID NO: 10)
miR-874-5p (SEQ ID NO: 11)
miR-4281 (SEQ ID NO: 12)
miR-1207-5p (SEQ ID NO: 13)
miR-30b-5p (SEQ ID NO: 14)
miR-29b-3p (SEQ ID NO: 15)
miR-199b-5p (SEQ ID NO: 16)
miR-30e-5p (SEQ ID NO: 17)
miR-26a-5p (SEQ ID NO: 18)
miR-4324 (SEQ ID NO: 19)

miRNAs which are downregulated in the differentiated MSCs as compared to the non-differentiated MSCs include for example:
miR-503-5p (SEQ ID NO: 20)
miR-3659 (SEQ ID NO: 21)
miR-3529-3p (SEQ ID NO: 22)
miR-320b (SEQ ID NO: 23)
miR-1275 (SEQ ID NO: 24)
miR-3132 (SEQ ID NO: 25)
miR-495-5p (SEQ ID NO: 26)
miR-181b-5p (SEQ ID NO: 27)
miR-424-5p (SEQ ID NO: 28)
miR-4284 (SEQ ID NO: 29)
miR-574-5p (SEQ ID NO: 30)
miR-143-3p (SEQ ID NO: 31)
miR-106a-5p (SEQ ID NO: 32)
miR-455-3p (SEQ ID NO: 33)
miR-20a-5p (SEQ ID NO: 34)
miR-145-5p (SEQ ID NO: 35)
miR-324-3p (SEQ ID NO: 36)
miR-130b-3p (SEQ ID NO: 37)
miR-1305 (SEQ ID NO: 38)
miR-140-3p (SEQ ID NO: 39).

Additional miRNAs which are down-regulated include:
miR-320a (SEQ ID NO: 40)
miR-222-3p (SEQ ID NO: 41).

According to another embodiment, the cell population expresses an increased level of miR-3663-3p, miR-762, miR-4327, miR-3665, miR34a-5p, miR-4327, miRNA 3665 and/or miR132-3p as compared to non-differentiated MSCs.

According to still another embodiment, the cell population expresses an increased level of miR34a-5p and/or miR132-3p.

According to another embodiment, the cell population expresses a decreased level of miR-503-5p, miR-3659, miR-3529-3p, miR-320b, miR-424-5p, miR-320a and/or miR-222-3p as compared to non-differentiated MSCs.

According to still another embodiment, the cell population expresses a decreased level of miR-503-5p, miR-320b, miR-424-5p, miR-320a and/or miR-222-3p.

According to still another embodiment, the cell population expresses a decreased level of miR-150-3p.

According to yet still another embodiment, the cell population expresses a decreased level of miR-503-5p, miR-320b and/or miR-424-5p.

All of the above descriptions of increased or decreased level of expression are in comparison to non-differentiated MSCs.

Proteins which have upregulated expression levels in the differentiated cells compared to the non-differentiated cells are detailed in Table 7 of the Examples section.

Proteins which have downregulated expression levels in the differentiated cells compared to the non-differentiated cells are detailed in Table 8 of the Examples section.

As mentioned, according to at least some embodiments of the present invention, the cells and cell populations of the present invention may be used to treat a particular disease or disorder. The cell populations may be used directly following differentiation or may be enriched for a particular phenotype as described herein below.

The cells generated according to embodiments of this invention display a particular expression pattern of cell surface markers. Thus, for example, following differentiation the cells typically show a unique increased level of CD73 on their cell surface as compared to the same cell population prior to differentiation. In addition, following differentiation, the cells typically show a unique decreased level of CD44 on their cell surface as compared to the same cell population prior to differentiation.

Analyzing cell surface markers may be performed by using any method known in the art including for example, flow cytometry, HPLC, immunohistochemistry, in situ-PCR.

The present inventors propose that populations of MSCs can be enriched for NTF secreting MSCs by selecting for the cells which express these markers.

Thus, according to another aspect of the present invention there is provided a method of selecting mesenchymal stem cells (MSCs) which secrete neurotrophic factors (NTFs) from a mixed population of MSCs, comprising:

a) analyzing the cells of the mixed population of cells for at least one of the following parameters:
   (i) cells which express CD44 below a predetermined threshold;
   (ii) cells which express CD73 above a predetermined threshold; and
b) selecting cells which are positive for at least one of the parameters, thereby selecting the MSCs which secrete neurotrophic factors.

Sorting is typically effected 2 days or 3 days from the start of the directed differentiation protocol.

It will be appreciated that the mixed cell population from which the NTF secreting MSCs are selected will comprise MSCs at different differentiation states, secreting NTFs at different levels, depending on the differentiation method used and the time allotted for the cells to differentiate.

As mentioned, the NTF secreting MSC are selected according to one of the following criteria:
   (i) cells which express CD44 below a predetermined threshold;
   (ii) cells which express CD73 above a predetermined threshold.

Selecting cells which express CD73 is typically effected using an agent which binds specifically to CD73. Typically, the cells express sufficient CD73 on their membrane such that they are capable of being detected using methods such as FACS, MACS and immunopanning as further described herein below.

Selection of the predetermined threshold is typically effected for each individual mesenchymal stem cell population since it is based on the amount of expression of that cell surface marker on an identical population of mesenchymal stem cells prior to differentiation as further described herein below.

Typically, the selecting is effected using antibodies that are capable of specifically recognizing this cell-surface protein, although the present invention contemplates additional agents such as polynucleotides or small molecules.

Antibodies which recognize CD73 or CD44 may be obtained according to methods known in the art or may be obtained from commercial sources.

If the CD73 antibody is attached to a magnetic moiety (either directly, or indirectly through a cognate binding molecule), the heterogeneous cell population may be enriched for cells which highly express CD73 by magnetic activated cell separation.

If the CD73 antibody is attached to an affinity moiety, the heterogeneous cell population may be enriched for CD73$^+$ cells by affinity purification with the cognate binding molecule. Thus, for example, if the CD73 antibody is attached to biotin, the heterogeneous cell population may be depleted of CD73$^+$ cells by purification with streptavidin beads or column. The CD73$^+$ cells can subsequently be retrieved. If, for example the CD73 antibody is attached to an antibody or an Fc of an antibody, the heterogeneous cell population may be depleted of CD73$^+$ cells by purification with protein A beads or column. The CD73$^+$ cells can subsequently be retrieved. If the CD73 antibody is attached to a fluorescent moiety, the heterogeneous cell population may be enriched for CD73$^+$ cells by using a fluorescence-activated cell sorter (FACS).

As used herein, the term "flow cytometry" refers to an assay in which the proportion of a material (e.g. renal cells comprising a particular marker) in a sample is determined by labeling the material (e.g., by binding a labeled antibody to the material), causing a fluid stream containing the material to pass through a beam of light, separating the light emitted from the sample into constituent wavelengths by a series of filters and mirrors, and detecting the light.

A multitude of flow cytometers are commercially available including for e.g. Becton Dickinson FACScan and FACScalibur (BD Biosciences, Mountain View, Calif.). Antibodies that may be used for FACS analysis are taught in Schlossman S, Boumell L, et al, [Leucocyte Typing V. New York: Oxford University Press; 1995] and are widely commercially available.

It will be appreciated that using a FACS sorter it is also possible to select for cells which have a particular level of surface markers.

The present invention, in at least some embodiments, contemplates analyzing a level of CD73 on the undifferentiated MSC population and then selecting a cell population of the corresponding differentiated MSC population which has an increase in expression by at least 1.5 or at least 2 fold or more.

Additionally, or alternatively, the present invention, in at least some embodiments, contemplates analyzing a level of CD44 on the undifferentiated MSC population and then selecting a cell population of the corresponding differentiated MSC population which has a decrease in expression by at least 1.5 or at least 2 fold or more.

The present invention, in at least some embodiments, also contemplates analyzing the expression of additional cell surface markers (such as CD105) over the course of the differentiation protocol. CD105 expression is initially increased (after the second day) following differentiation, but at the time of maximum NTF secretion (after the third day), the CD105 expression is decreased. Thus, the present invention, in at least some embodiments, contemplates selecting NTF-secreting MSCs by selecting those cells that have a decrease in expression of CD105, e.g. by at least 0.5 fold, at least 1 fold or at least 2 fold.

Following generation and optional cell surface marker analysis, the NTF-secreting MSCs may be further analysed (e.g. karyotype analysis, morphology, cell number and viability, gram staining, sterility).

The generated cell populations are typically removed from the culture plate using cell dispersing agents. Preferably single cell populations are obtained. Examples of agents that may be used to disperse the cells include, but are not limited to collagenase, dispase, accutase, trypsin (e.g. trypsin-EDTA, non-animal substitutes of trypsin such as TrypLE™), papain. Alternatively, or additionally trituration may also be performed to increase the dispersal of the cells.

An exemplary concentration of trypsin that may be used is 0.005-0.5% trypsin-EDTA. The cells may be incubated with the dispersing agent for about 5-30 minutes, at a temperature of about 37° C.

Harvesting of the cells is typically carried out in an appropriate medium e.g. Hanks balanced salt solution (HBSS), Dulbecco Modified Eagle Medium (DMEM) RPMI, PBS etc.

Optionally, the cells are and may be preserved at this stage—for example frozen or cryopreserved. This may be relevant for repeated administrations to patients.

Optionally, the cells may be qualified or characterized prior to cryopreservation or alternatively prior to administration to the subject. Once qualified, the cells may be labeled accordingly or may be directly administered to the subject.

Thus, according to another aspect of the present invention there is provided a method of qualifying cells which secrete neurotrophic factors, comprising analyzing the cells for expression at least one miRNA selected from the group consisting of miR-503, miR-3659, miR-3529-3p, miR-320b, miR-424-5p, miR-320a, miR-222-3p, miR-3663-3p, miR-762, miR-4327, miR-3665, miR34a-5p, miR-4327, miRNA 3665 and miR132-3p; wherein an increased expression of the miR-3663-3p, miR-762, miR-4327, miR-3665, miR34a-5p, miR-4327, miRNA 3665 or miR132-3p compared to non-differentiated MSCs or a decreased expression of the miR-503, miR-3659, miR-3529-3p, miR-320b, miR-424-5p, miR-320a or miR-222-3p, compared to non-differentiated MSCs is indicative of cells which secrete neurotrophic factors.

According to a particular embodiment, the miRNAs are selected from the group consisting of miR-503, miR-320b, miR424-5p, miR-132-3p and miR-34a-5p.

Preferably, the change in expression in the miRNAs is a statistically significant amount.

Preferably, the control cells to which the differentiated cells are compared are the same cells which are used to generate the cells which secrete the neurotrophic factors (i.e. non-differentiated MSCs of the same donor and from the same organ).

Analyzing for expression of miRNAs may be effected using any method known in the art including miRNA array analysis, PCR analysis etc.

Another method of qualifying the cells is by analysis of protein expression.

Thus, according to another aspect of the present invention there is provided a method of qualifying cells which have been ex vivo differentiated from MSCs which secrete neurotrophic factors, comprising analyzing the cells for expression at least one protein selected from the group consisting of Isobutyryl-CoA dehydrogenase, C-X-C motif chemokine 6, Neuromodulin, Growth/differentiation factor 15, Hyaluronan synthase 1, Interleukin-1 beta, Interleukin-8, Inhibin beta A chain, Insulin receptor substrate 1, Integrin alpha-1, Laccase domain-containing protein 1, Laminin subunit alpha-4, Lumican, Collagenase 3, Normal mucosa of esophagus-specific gene 1 protein, Pre-B-cell leukemia transcription factor-interacting protein 1, Pleckstrin homology-like domain family A member 1, Phosphatidylinositol 3,4,5-trisphosphate-dependent Rac exchanger 1 protein, Prostaglandin E synthase, Prostaglandin G/H synthase 2, Ras-related protein Rab-27B, Rho-related GTP-binding protein RhoB, Sialate O-acetylesterase, Monocarboxylate transporter 7, Tissue factor pathway inhibitor 2, Transmembrane protein 65, Vam6/Vps39-like protein, 3-oxo-5-beta-steroid 4-dehydrogenase, Propionyl-CoA carboxylase beta chain, mitochondrial, Interferon regulatory factor 2-binding protein-like, Tissue alpha-L-fucosidase, Aldo-keto reductase family 1 member C2, Inositol 1,4,5-trisphosphate receptor-interacting protein, Protein KIAA1199, Selenium-binding protein 1, Phospholipase D3, GTP:AMP phosphotransferase, mitochondrial, Protein Wnt-5a; Protein Wnt, Aldo-keto reductase family 1 member C3, Sorting nexin-9, Gap junction alpha-1 protein, Pyruvate carboxylase, mitochondrial, SH3 and PX domain-containing protein 2B, Integrin alpha-2, Cytochrome P450 1B1, Chitinase-3-like protein 1, Nicotinamide phosphoribosyltransferase, Seprase, Superoxide dismutase, Aldo-keto reductase family 1 member C1, FERM, RhoGEF and pleckstrin domain-containing protein 1, Prolyl 4-hydroxylase subunit alpha-3, Ribonucleoside-diphosphate reductase subunit M2 B, Core histone macro-H2A.2; Histone H2A, Choline transporter-like protein 1 and Niemann-Pick C1 protein, Lysosomal alpha-glucosidase; wherein an increase in expression of the at least one protein compared to non-differentiated MSCs is indicative that the cells secrete neurotrophic factors.

According to another aspect of the present invention there is provided a method of qualifying cells which have been ex vivo differentiated from MSCs which secrete neurotrophic factors, comprising analyzing the cells for expression at least one protein selected from the group consisting of Tight junction protein ZO-2, Alpha-1,3-mannosyl-glycoprotein 2-beta-N-acetylglucosaminyltransferase, Smoothelin, Ectopic P granules protein 5 homolog, BRCA1-associated ATM activator 1, WD repeat-containing protein 36, SH3 domain-binding protein 4, EH domain-binding protein 1-like protein 1, Ras GTPase-activating-like protein IQGAP3, Lysyl oxidase homolog 2, Tropomyosin 1 (Alpha), isoform CRA_f, Gem-associated protein 5, Tripartite motif-containing protein 16, Connective tissue growth factor, Lymphokine-activated killer T-cell-originated protein kinase, Tetratricopeptide repeat protein 4, Breast cancer anti-estrogen resistance protein 1, Ribonucleoside-diphosphate reductase subunit M2, Ubiquitin-conjugating enzyme E2 C, Neutrophil defensin 1, Cdc42 effector protein 3, Condensin complex subunit 2, Ig kappa chain C region, Condensin complex subunit 3, Syncoilin, Structural maintenance of chromosomes protein 2, Condensin complex subunit 1, Inter-alpha-trypsin inhibitor heavy chain H4, Thymidylate synthase, Serotransferrin, Pregnancy zone protein, DNA replication licensing factor MCMI, Hemopexin DNA mismatch repair protein Msh6, Ankyrin repeat domain-containing protein 13A, Phosducin-like protein 3, 1-phosphatidylinositol 4,5-bisphosphate phosphodiesterase beta-3, Complement C3; DNA replication licensing factor MCM3, CD97 antigen; CD97 antigen subunit alpha, DNA replication licensing factor MCM6, DNA replication licensing factor MCM4, Disabled homolog 2, Protein KIAA0664, DNA replication licensing factor MCM2, Protein-lysine 6-oxidase, Ribonucleoside-diphosphate reductase large subunit, Melanoma-associated antigen D2, Ig gamma-1 chain C region, Heparanase, Importin subunit alpha-2, Asparagine synthetase [glutamine-hydrolyzing], Alpha-2-macroglobulin, Collagen alpha-1(I) chain, Collagen alpha-1(V) chain, DnaJ homolog subfamily B member 4, Thrombospondin-1, Serum albumin and Collagen alpha-2(I) chain, wherein a decrease in expression of the at least one protein compared to non-differentiated cells is indicative that the cells secrete neurotrophic factors.

Preferably, the change in expression in the protein analyzed is a statistically significant amount (i.e. a statistically significant increase or a statistically significant decrease).

Preferably, the control cells to which the differentiated cells are compared are the same cells which are used to generate the cells which secrete the neurotrophic factors (i.e. non-differentiated MSCs of the same donor and from the same organ).

Analyzing for expression of proteins may be effected using any method known in the art including Western Blot, immunocytochemistry, Mass spectrometry, radioimmunoassay, etc. According to a particular embodiment, the analyzing is effected using an antibody which specifically recognizes the protein.

As mentioned, the cells of embodiments of this invention can be used for preparing a medicament (interchangeably referred to as pharmaceutical composition), whereby such a medicament is formulated for treating diseases which can be beneficially treated with cells secreting neurotrophic factors.

Examples of such diseases include neurodegenerative diseases and immune diseases (e.g. autoimmune diseases) of the nervous system.

The term "neurodegenerative disease" is used herein to describe a disease which is caused by damage to the central nervous system. Exemplary neurodegenerative diseases which may be treated using the cells and methods according to the present invention include for example: Amyotrophic Lateral Sclerosis (ALS), Parkinson's disease, Multiple System Atrophy (MSA), Huntington's disease, Alzheimer's disease, Rett Syndrome, lysosomal storage diseases ("white matter disease" or glial/demyelination disease, as described, for example by Folkerth, J. Neuropath. Exp. Neuro., September 1999, 58:9), including Sanfilippo, Gaucher disease, Tay Sachs disease (beta hexosaminidase deficiency), other genetic diseases, multiple sclerosis (MS), brain injury or trauma caused by ischemia, accidents, environmental insult, etc., spinal cord damage, ataxia. In addition, the present invention may be used to reduce and/or eliminate the effects on the central nervous system of a stroke in a patient, which is otherwise caused by lack of blood flow or ischemia to a site in the brain of the patient or which has occurred from physical injury to the brain and/or spinal cord. Neurodegenerative diseases also include neurodevelopmental disorders including for example, autism and related neurological diseases such as schizophrenia, among numerous others.

Autoimmune diseases of the nervous system which may be treated using the cells described herein include for example, multiple sclerosis and myasthenia gravis, Guillain bar syndrome, Multiple system Atrophy (MSA; a sporadic, progressive, adult-onset neurodegenerative disorder associated with varying degrees of parkinsonism, autonomic dysfunction and cerebellar ataxia). Other autoimmune diseases are described in Kraker et al., Curr Neuropharmacol. 2011 September; 9(3): 400-408, the contents of which are incorporated herein by reference.

The cells of the present invention can be administered to the treated individual using a variety of transplantation approaches, the nature of which depends on the site of implantation.

The term or phrase "transplantation", "cell replacement" or "grafting" injection are used interchangeably herein and refer to the introduction of the cells of the present invention to target tissue, such as the brain, the grey matter etc. The cells can be derived from the recipient (allogeneic) or from a non-allogeneic or xenogeneic donor.

The cells can be transplanted directly into the muscle (intramuscularly, such as in the muscles of the upper arm or leg), the respiratory muscles, the swallowing muscles, into the spinal cord (intrathecally), intravenously, directly into the brain or combinations of same (e.g. intramuscularly and intrathecally). Other modes of administration are also contemplated such as systemic administration.

An exemplary dose of cells that may be administered intramuscularly is $1-20 \times 10^6$ cells/site. The number of administrations per muscle may vary from 5-50, 10-30, 20-100, or from 15-25 during the course of the treatment. According to one embodiment, the total number of cells administered is between $20-2000 \times 10^6$, more preferably between $20-1000 \times 10^6$, more preferably between $20-500 \times 10^6$, more preferably between $20-200 \times 10^6$, more preferably between 20-100×10. According to a particular embodiment, each administration comprises $1 \times 10^6$ cells with between 20-30 administrations (for example 24), $1.5 \times 10^6$ cells with between 20-30 administrations (for example 24) during the course of the treatment, or $2 \times 10^6$ cells with between 20-30 administrations (for example 24).

An exemplary dose of cells that may be administered intrathecally is $0.5-20 \times 10^6$ cells/Kg body weight, more preferably $0.5-10 \times 10^6$ cells/Kg body weight, more preferably $1-10 \times 10^6$ cells/Kg body weight, more preferably $1-5 \times 10^6$ cells/Kg body weight, more preferably $1-2.5 \times 10^6$ cells/Kg body weight and more preferably $1-2 \times 10^6$ cells/Kg body weight.

For a combination of both intramuscular delivery and intrathecal delivery, the present invention, in at least some embodiments contemplates intramuscular delivery of about $1-10 \times 10^6$ cells/site, more preferably between $1-5 \times 10^6$ cells/site and more preferably between $1-2.5 \times 10^6$ cells/site. The number of sites may vary from 5-50, 10-30, 20-100, or from 15-25—e.g. 24; and $1-10 \times 10^6$ cells/Kg body weight and more preferably between $1-5 \times 10^6$ cells/Kg body for intrathecal delivery. According to one embodiment, a maximum number per administration of about $20-1400 \times 10^6$ cells per 70 kg patient is contemplated, more preferably between $50-1000 \times 10^6$ cells per 70 kg patient is contemplated, more preferably between $50-500 \times 10^6$ cells per 70 kg patient is contemplated, more preferably between $50-200 \times 10^6$ cells per 70 kg patient is contemplated. According to another embodiment, a maximum number of about $20-500 \times 10^6$ cells per 70 kg patient is contemplated. According to another embodiment, a maximum number of about $100-2000 \times 10^6$ cells per 70 kg patient is contemplated, and more specifically $200 \times 10^6$ cells per 70 kg patient is contemplated.

In any of the methods described herein, the cells can be administered either per se or, preferably as a part of a pharmaceutical composition that further comprises a pharmaceutically acceptable carrier.

As used herein a "pharmaceutical composition" refers to a preparation of one or more of the chemical conjugates described herein, with other chemical components such as pharmaceutically suitable carriers and excipients. The purpose of a pharmaceutical composition is to facilitate administration of a compound to a subject.

Hereinafter, the term "pharmaceutically acceptable carrier" refers to a carrier or a diluent that does not cause significant irritation to a subject and does not abrogate the biological activity and properties of the administered compound. Examples, without limitations, of carriers are propylene glycol; saline; emulsions; buffers; culture medium such as DMEM or RPMI; hypothermic storage medium containing components that scavenge free radicals, provide pH buffering, oncotic/osmotic support, energy substrates and ionic concentrations that balance the intracellular state at low temperatures; and mixtures of organic solvents with water.

Typically, the pharmaceutical carrier preserves the number of cells (e.g. is not reduced by more than 90%) in the composition for at least 24 hours, at least 48 hours or even at least 96 hours.

Herein the term "excipient" refers to an inert substance added to a pharmaceutical composition to further facilitate administration of a compound and maintain cells viability at a pre-determined temperature for a suitable period of time before transplantation/injection. Examples, without limitation, of excipients include albumin, plasma, serum and cerebrospinal fluid (CSF), antioxidants such as N-Acetylcysteine (NAC) or resveratrol.

According to a preferred embodiment of the present invention, the pharmaceutical carrier is an aqueous solution of buffer or a culture medium such as DMEM.

Techniques for formulation and administration of drugs may be found in "Remington's Pharmaceutical Sciences," Mack Publishing Co., Easton, Pa., latest edition, which is incorporated herein by reference.

For any preparation used in the methods of the invention, the therapeutically effective amount or dose can be estimated initially from in vitro and cell culture assays. Preferably, a dose is formulated in an animal model to achieve a desired concentration or titer. Such information can be used to more accurately determine useful doses in humans.

Toxicity and therapeutic efficacy of the active ingredients described herein can be determined by standard pharmaceutical procedures in vitro, in cell cultures or experimental animals. For example, 6-OHDA-lesioned mice or rats may be used as animal models of Parkinson's. In addition, a sunflower test may be used to test improvement in delicate motor function by challenging the animals to open sunflowers seeds during a particular time period Animal models for testing improvement of motor function in MSA patients are disclosed for example in Stefanova et al., Trends Neurosci. 2005 September; 28(9):501-6.

Transgenic mice may be used as a model for Huntingdon's disease which comprise increased numbers of CAG repeats have intranuclear inclusions of huntingtin and ubiquitin in neurons of the striatum and cerebral cortex but not in the brain stem, thalamus, or spinal cord, matching closely the sites of neuronal cell loss in the disease. Transgenic mice may be used as a model for ALS disease which comprise SOD-1 mutations—see for example Uccelli A et al., Mol Med 2012, April 2.

The septohippocampal pathway, transected unilaterally by cutting the fimbria, mimics the cholinergic deficit of the septohippocampal pathway loss in Alzheimers disease. Accordingly animal models comprising this lesion may be used to test the cells of the present invention for treating Alzheimers.

Survival and rotational behavior (e.g. on a rotarod) of the animals may be analysed following administration of the cells of the present invention.

The data obtained from these in vitro and cell culture assays and animal studies can be used in formulating a range of dosage for use in human. Further information may be obtained from clinical studies—see for example Salem H K et al., Stem Cells 2010; 28:585-96; and Uccelli et al. Lancet Neurol. 2011; 10:649-56).

The dosage may vary depending upon the dosage form employed and the route of administration utilized. The exact formulation, route of administration and dosage can be chosen by the individual physician in view of the patient's condition, (see e.g., Fingl, et al., 1975, in "The Pharmacological Basis of Therapeutics", Ch. 1 p. 1). For example, ALS patients can be monitored symptomatically for improved motor functions indicating positive response to treatment.

For injection, the active ingredients of the pharmaceutical composition may be formulated in aqueous solutions, preferably in physiologically compatible buffers such as Hank's solution, Ringer's solution, or physiological salt buffer and additional agents as described herein above.

Dosage amount and interval may be adjusted individually to levels of the active ingredient which are sufficient to effectively regulate the neurotransmitter synthesis by the implanted cells. Dosages necessary to achieve the desired effect will depend on individual characteristics and route of administration.

Depending on the severity and responsiveness of the condition to be treated, dosing of cells can be of a single or a plurality of administrations, with course of treatment lasting from several days to several weeks or months depending when diminution of the disease state is achieved.

The amount of a composition to be administered will, of course, be dependent on the individual being treated, the severity of the affliction, the manner of administration, the judgment of the prescribing physician, etc. The dosage and timing of administration will be responsive to a careful and continuous monitoring of the individual changing condition. For example, a treated ALS patient will be administered with an amount of cells which is sufficient to alleviate the symptoms of the disease, based on the monitoring indications.

The cells of the present invention, in at least some embodiments, may be prepackaged in unit dosage forms in a syringe ready for use. The syringe may be labeled with the name of the cells and their source. The labeling may also comprise information related to the function of the cells (e.g. the amount of neurotrophic factor secreted therefrom). The syringe may be packaged in a packaging which is also labeled with information regarding the cells.

The cells of the present invention, in at least some embodiments, may be co-administered with therapeutic agents useful in treating neurodegenerative disorders, such as gangliosides; antibiotics, neurotransmitters, neurohormones, toxins, neurite promoting molecules; and antimetabolites small molecule agents and precursors of neurotransmitter molecules such as L-DOPA. For ALS, for example the cells of the present invention may be co-administered with Rilutek® (riluzole, Sanofi Aventis). Additionally, or alternatively, the cells of the present invention, in at least some embodiments, may be co-administered with other cells capable of synthesizing a neurotransmitter. Such cells are described in U.S. Pat. Appl. No. 20050265983, incorporated herein by reference.

As used herein the term "about" refers to ±10%.

Additional objects, advantages, and novel features of the present invention will become apparent to one ordinarily skilled in the art upon examination of the following examples, which are not intended to be limiting.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the non-limiting description of some embodiments of the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Generation of Mesenchymal Stem Cells that Secrete Neurotrophic Factors (MSC-NTF)

In this non-limiting example, the production process for clinical grade mesenchymal bone marrow stromal cells, secreting neurotrophic factors (MSC-NTF) involves the following main steps:
 1. Bone marrow aspiration (BMA)
 2. Separation of the mononuclear cells (MNC)
 3. Enrichment and propagation of Multipotent Mesenchymal Stromal Cells (MSC)
 4. Induction of differentiation into MSC-NTF cells
 5. Harvesting of final product
 6. Product Packaging and labeling
 7. Product release for transplantation Differentiation into MSC-NTF secreting cells may be induced between passages 2 to 6.

Bone Marrow Aspiration (BMA):

Fresh bone marrow was aspirated according to the routine Medical Center procedure from the patient's iliac-crest under local anesthesia and sedation by an anesthetist. Bone marrow (30-60 ml) was aspirated using aspiration needles into heparin containing tubes. The bone marrow aspiration procedure is preceded by documentation reporting negative test results for HBV, HCV and HIV.

Separation of MNC and Enrichment of MSC:

The first step of the production process involves separation of mononuclear cells (MNC) from total bone marrow.

The Human Multipotent Mesenchymal stromal cells (MSC), estimated to comprise 0.01% of total bone marrow MNC, are enriched in-vitro from MNC, by virtue of their ability to adhere to plastic.

Bone marrow aspirate was diluted 1:1 (v:v) in Hank's Balanced Salt Solution (HBSS), and MNC were separated from total bone marrow cells by Ficoll density gradient centrifugation.

MNC were counted and cell number and viability were determined by the Trypan Blue dye exclusion test. The yield of MNC recovered after density gradient centrifugation varied between donors and depends on the volume of bone marrow collected. The yield of MNC recovered from 30-50 ml of bone marrow aspirate of ALS patients ranged between 70-400×$10^6$ MNC and was sufficient for isolating the number of MSC necessary for the entire production process.

The medium used for seeding the primary bone marrow mononuclear cells and propagating the MSCs throughout the production process was designated Platelets Growth medium (PM). The PM medium was used throughout the MSC production process (Passage 0-Passage 6) [P0-P6] and contained low glucose DMEM, L-Glutamine sodium pyruvate, heparin and platelet lysate.

MNCs were seeded at a density of 100,000-400,000 cells/$cm^2$ in flasks in PM/flask and incubated overnight in a 37° C./5% $CO_2$ humidified incubator. The next day, the cell culture was examined under the microscope. At this stage, non-adherent, mononuclear cell were floating in the culture supernatant and plastic-adherent MSC were attached to the flask surface. The culture supernatant containing the non adherent mononuclear cells was removed, and the adherent cells were gently washed with DMEM. The DMEM was discarded and fresh PM was added to each flask containing the plastic adherent MSC cells. The process phase from MNC seeding to MSC harvesting was designated Passage 0 (P0).

The P0 cells were incubated in a 37° C./5% $CO_2$ humidified incubator and PM was replaced twice a week, with fresh PM, until the culture was sub-confluent.

Upon harvesting Passage 1, the MSC cell population was characterized by flow cytometry by expression (>95% positive) of CD73, CD90 and CD105 on the cell surface. To confirm the purity of the cell population and to exclude the presence of hematopoietic cell contamination these cells should lack expression (<2% positive) of CD3, CD14, CD19, CD34, CD45, and HLA-DR as determined by flow cytometry.

Propagation of MSC:

Primary cultures of MSC were grown in-vitro as a single cell layer attached to a plastic substrate. Once the available substrate surface was covered by cells (a confluent culture), growth slowed and then ceased. Thus, in order to keep the cells healthy and actively growing, it was necessary to subculture them at regular intervals, when the culture was sub-confluent. Each subculture cycle is designated Passage. The cultures may be sub cultivated up to Passage 6. The MSC cultures were continuously monitored by careful microscope inspection throughout the production process and monitored for MSC plastic adherence and characteristic morphological appearance.

The MSC culture was passaged at a density of 500-2,000 cells/$cm^2$.

For passaging MSC, the culture supernatant was removed from the flask and a Trypsin (Invitrogen) was added to each flask. The flask was incubated for several minutes at 37° C. and the resulting cell suspension was collected from the flask into centrifuge tubes and DMEM was added to each flask for diluting the Trypsin and collecting the remaining cells.

The cell suspension was centrifuged re-suspended in PM, counted and reseeded at a density of 500-2,000 cells/$cm^2$ in new culture vessels. The cultures were then incubated in a 37° C./5% $CO_2$ humidified incubator.

In the course of each passage the PM was replaced every 3-4 days, by removing all the culture supernatant and replacing it with the same volume of fresh PM.

Induction of Differentiation:

Beginning at Passage 2 (but no later than Passage 6), once the culture was estimated to contain a sufficient number of cells, MSC were harvested and re-seeded for induction of differentiation into NTF secreting cells (MSC-NTF).

MSC were seeded for induction of differentiation in PM at a concentration of over 6,000-8,000 cells/$cm^2$. Three days later, differentiation was induced by replacing the PM with differentiation medium (S2M) containing low glucose DMEM supplemented with 1 mM dibutyryl cyclic AMP (cAMP), 20 ng/ml human Basic Fibroblast Growth Factor (hbFGF), 5 ng/ml human platelet derived growth factor (PDGF-AA), and 50 ng/ml human Heregulin β1. The culture was maintained in differentiation medium for 3 days until harvesting.

One day before the end of differentiation, the culture supernatant was sampled for analyzing GDNF and BDNF secretion by ELISA or HPLC and cells were harvested for analysis of cell surface markers.

Harvesting of Final Product for Transplantation:

At the end of the differentiation process the NTF-secreting cells (MSC-NTF) were harvested for transplantation. The MSC-NTF cells were washed in DMEM and cell number and viability are determined Only cultures resulting in >80% cell viability were released for transplantation. The cells were re-suspended in DMEM concentration of $10 \times 10^6$ cells/ml for IM transplantation, and at a concentration of $22.5\text{-}30 \times 10^6$ (since the volume for injection is constant, the final cell concentration is based on patient weight).

At the end of the differentiation process, the culture supernatant was collected and sampled for NTF (GDNF and BDNF) secretion.

Figure 1A:
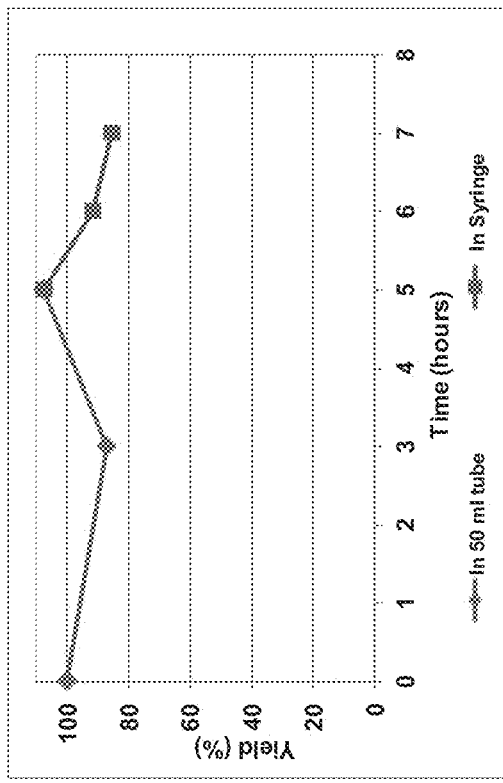
Figure 1B:
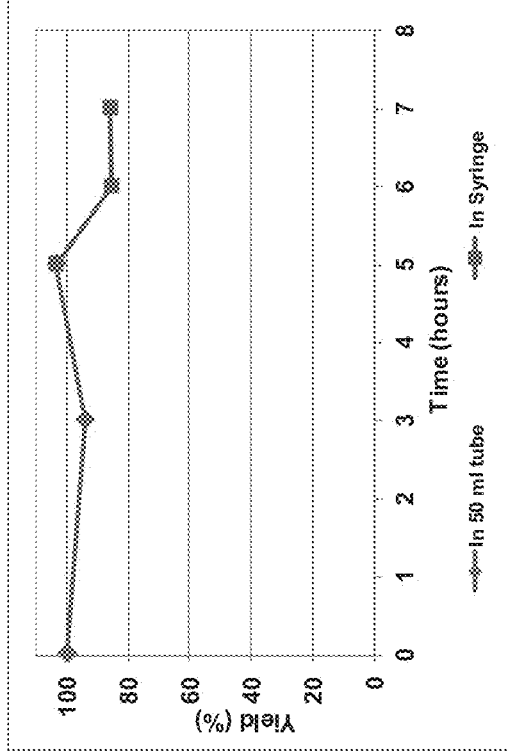

Final Product Stability:

Stability of MSC-NTF final product in medium or salt solution was evaluated at 2-8° C. for up to 7 hours postharvest at two cell concentrations: $10 \times 10^6$ cells/ml, the cell concentration used for IM transplantation and $35 \times 10^6$ cells/ml, the maximum cell concentration anticipated for IT transplantation. The cells were incubated at 2-8° C. for 5 hours in a 50 ml tube and then transferred to 1 ml and 5 ml syringes respectively for two more hours at the same temperature. The results indicate that number of cells at both concentrations was stable for a total of 7 hours and is in the range of 80-100% (FIGS. 1A-B).

Product Packaging and Labeling:

Each treatment package consists of ready for injection syringe(s) containing freshly harvested autologous cultured mesenchymal bone marrow stromal cells secreting neurotrophic factors (MSC-NTF) in accordance with the dose defined for the appropriate route of administration in the clinical study protocol.

The primary label will be affixed to each syringe, that will be packaged in a Single Syringe Case and the secondary label will be affixed to the syringe case or Compartment Tray and transferred to the physician for transplantation.

The MSC-NTF cells harvested one day prior to transplantation were analysed by flow cytometry for expression of CD 44 and CD73 on the cell surface as compared to expression of MSC of the same patient. In addition, the MSC-NTF were analysed by ELISA for secreted neurotrophic factors (GDNF and BDNF). This assay was repeated on the culture supernatant harvested on the day of transplantation.

Sterility tests are performed on the pooled culture supernatant 3 days prior to transplantation. *Mycoplasma* culture and nPCR tests are performed from the flask randomly harvested 1 or two days before the end of differentiation. Endotoxin and Gram staining tests were performed on the final product on the day of transplantation.

Selection of MSC-NTF was effected according to the criteria in Table 1, herein below.

TABLE 1

| Specifications | Method reference | Test |
| --- | --- | --- |
| The cell suspension is essentially free of visible particles of foreign matter. | Visual Inspection USP 29 <788> (Particulate Matter in Injections) | 1. Appearance |

TABLE 1-continued

| Specifications | Method reference | Test |
|---|---|---|
| CD44, CD73, >95% positive, CD44 MFI of MSC-NTF 0.67 ± 0.1 as compared to MSC of the same patient and CD 73 MFI 1.76 ± 0.7 as compared to MSC of the same patient | FACS analyses for surface markers | 2. Identity (performed on the day prior to transplantation) |
| For IM administration NMT 300 EU, <1 EU/ml<br>For IT administration NMT 12 EU, <0.03 EU/ml | LAL test USP 29<85> | 3. Purity |
| GDNF 2-20 fold MSC-NTF vs MSC | ELISA for GDNF | 4. Potency |
| BDNF 2-5 fold MSC-NTF vs MSC | ELISA for BDNF | 5. Potency |
| According to Route of Administration:<br>IM: 48 × $10^6$ cells [2 × $10^6$ cells/site × 24 sites]<br>IT: 90 × $10^6$ cells [1.5-2 × $10^6$ cells/Kg body weight] | Trypan Blue exclusion dye | 6. Total cell number |
| >80% | Trypan Blue exclusion dye | 7. Viable cell count |
| 0.3 ml for IM transplantation<br>4 ml for IT transplantation | USP 29 <1> | 8. Volume of syringe |
| Negative test results | USP 34<71> | 9. Sterility Tests: |
| Negative test results | Gram Staining | 10. Rapid Microbial contamination |
| Negative test results | 21 CFR Subpart D, Sec. 610.30 and nPCR | 11. Mycoplasma |

Results

Isolation and Propagation of ALS Patients MSC:

The yield of mononuclear cells separated from ALS patients bone marrow varied between patients and was in the range of 70-400×$10^6$ cells. The number of MSC enriched from ALS patients' mononuclear cells was also variable in the range of 5-150×$10^6$.

Figure 2:
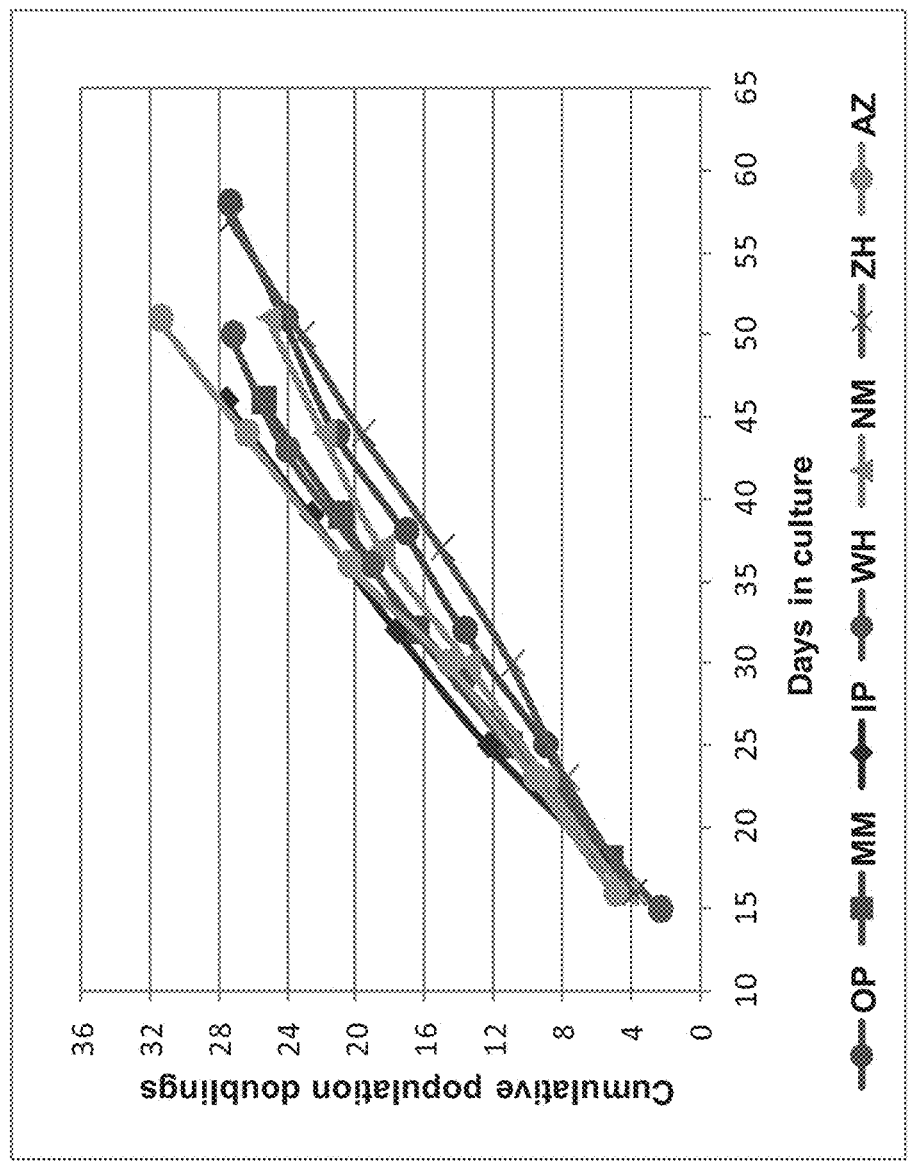

MSC of ALS patients were grown and passaged for up to 7 passages (32 population doublings) for a total of up to 60 days (FIG. 2). The average population doubling time was 0.5 days. Notwithstanding patient to patient variability in MSC cell number the cell propagation process was consistent and reproducible (FIG. 2).

Phenotypic Characterization of MSC:

MSC cells of ALS patients were characterized by flow cytometry analysis of surface antigen expression. MSC of ALS patients were found to express CD105, CD73 and CD90 on the cell surface (>95% positive) and to lack expression (<2% positive) of CD3, CD14, CD19, CD34, CD45, and HLA-DR as determined by flow cytometry, which excludes the presence of hematopoietic cell contamination, as illustrated in Table 2, herein below.

TABLE 2

| Patient Initials | CD marker (% positive) | | | | | | | | |
|---|---|---|---|---|---|---|---|---|---|
|  | CD73 | CD90 | CD105 | CD3 | CD14 | CD19 | CD34 | CD45 | HLA-DR |
| O P | 99.88 | 99.98 | 99.69 | 0 | 0(Neg) | 0(Neg) | 2.22 | 0 | 0(Neg) |
| S R | 99.63 | 99.5 | 99.23 | 0 | 0(Neg) | 0 | 0 | 0 | 0(Neg) |
| M M | 99.84 | 95.31 | 99.64 | 0(Neg) | 0(Neg) | 0(Neg) | 0(Neg) | 0(Neg) | 0(Neg) |
| I P | 99.76 | 96.41 | 99.44 | 0(Neg) | 0(Neg) | 0(Neg) | 0(Neg) | 0(Neg) | 0(Neg) |
| W H | 99.84 | 98.34 | 99.48 | 0(Neg) | 0(Neg) | 0(Neg) | 0(Neg) | 0(Neg) | 0(Neg) |
| N M | 99.26 | 97.76 | 99.33 | 0(Neg) | 0(Neg) | 0(Neg) | 0(Neg) | 0(Neg) | 0(Neg) |
| V S | 99.18 | 94.07 | 96.39 | 0(Neg) | 0.77 | 0(Neg) | 0.29 | 0(Neg) | 0(Neg) |
| K Y | 99.81 | 82.77 | 96.39 | 0(Neg) | 0(Neg) | 0(Neg) | 0(Neg) | 0(Neg) | 0(Neg) |
| M S | 99.82 | 99.6 | 99.68 | 0(Neg) | 0(Neg) | 0(Neg) | 0(Neg) | 0(Neg) | 0(Neg) |
| Z H | 99.45 | 98.75 | 99.03 | 0(Neg) | 0(Neg) | 0(Neg) | 0(Neg) | 0(Neg) | 0(Neg) |
| A Z | 99.45 | 98.75 | 99.03 | 0(Neg) | 0(Neg) | 0(Neg) | 0(Neg) | 0(Neg) | 0(Neg) |
| R S | 99.39 | 93.91 | 97.85 | 0(Neg) | 0(Neg) | 0(Neg) | 0(Neg) | 0(Neg) | 0(Neg) |

Figure 4A:
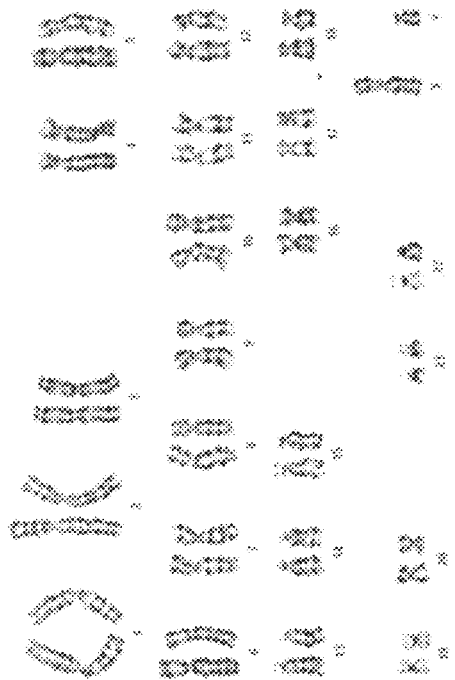
Figure 4B:
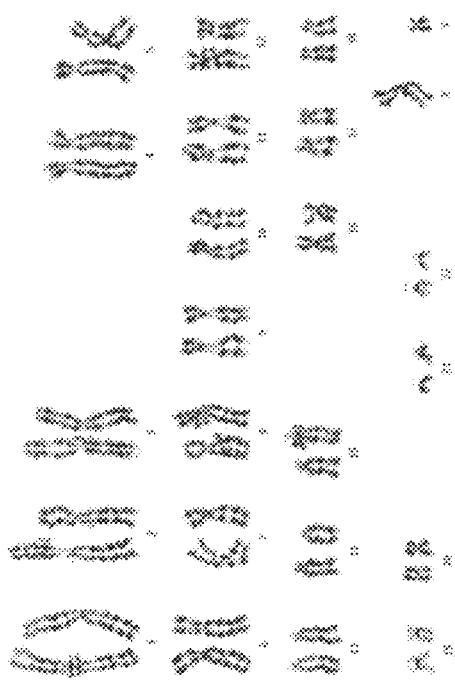

Additional Characterization: Trilineage Differentiation, Morphological Analysis and Cytogenic Analysis:

To confirm the identity of the MSC cells, during development of the manufacturing process MSC were shown to undergo differentiation into adypocyte, osteocyte and chondrocyte lineages (FIGS. 3A-I). Osteoblast formation was induced by culturing MSCs with dexamethasone (Dex), ascorbate, glycerophosphate, and assessed using osteocalcin antibody. Adipocytes were induced by culturing MSCs with basic medium supplemented with hydrocortisone, isobutyl-methylxanthine, and indomethacin in 95% ethanol and identified by the presence of Oil Red O-stained neutral lipids in the cytoplasm. Chondrocyte formation of MSCs was induced in dexamethasone, ascorbate-phosphate, proline, pyruvate and TGF-β3 and determined by the secretion of Alcian Blue-stained sulfated proteoglycan and Dapi counterstaining (FIGS. 3A-I). Cytogenetic analysis was conducted on MSC of ALS patients to confirm chromosome stability and a normal karyotype after five passages. At least 14 metaphase cells were analysed in each expanded sample. No trisomy, tetraploidy, or chromosomal rearrangement was observed, as shown in FIGS. 4A-B.

As illustrated in FIGS. 5A-F, cryopreservation did not affect the ability of MSCs of ALS patients to differentiate into the adipocyte, osteocyte and chondrocyte lineages.

Figures 6A, 6B:
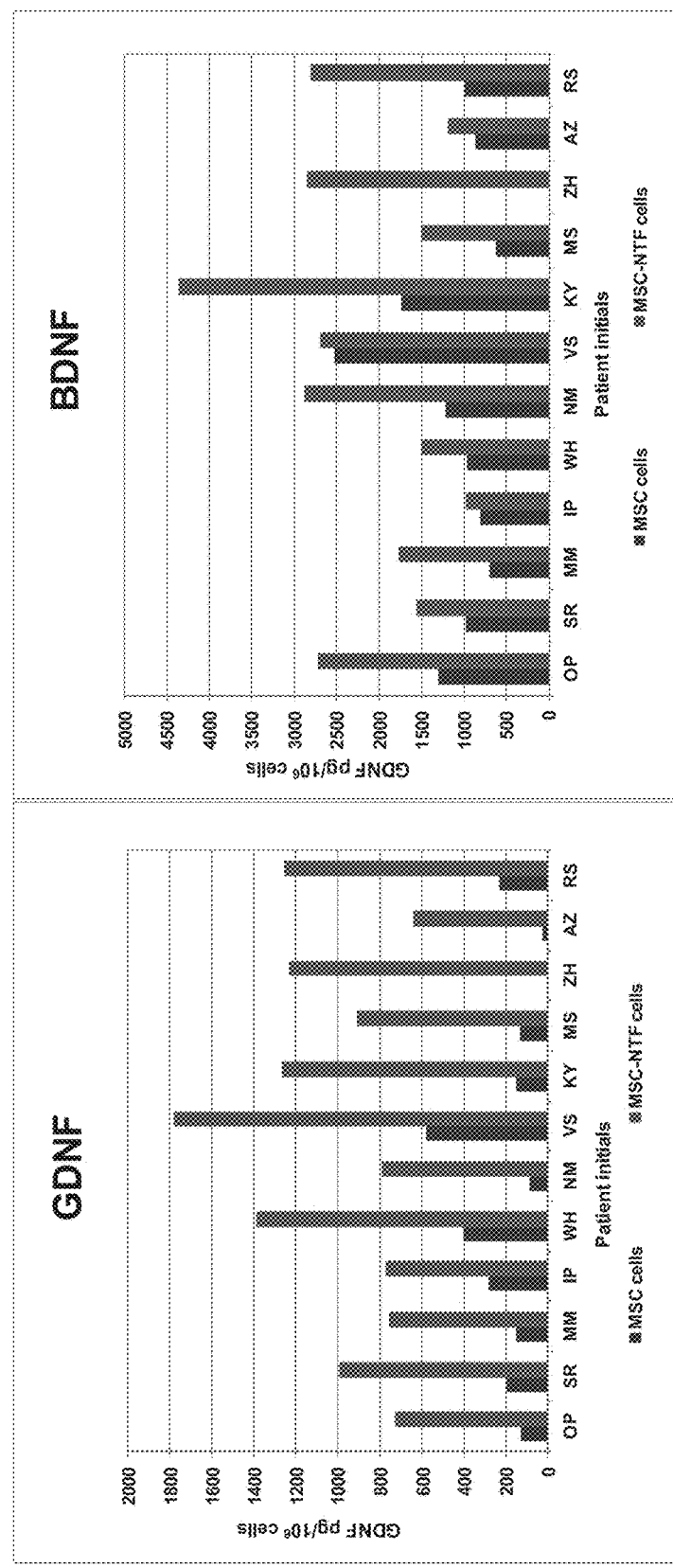

Differentiation of MSC into MSC-NTF Secreting Cells:

NTF secretion: Differentiation into MSC-NTF secreting cells was induced at MSC passage 3 cells in 12 ALS patients during the Phase I/II clinical study, using the differentiation medium. Following differentiation, NTF secretion was measured using the ELISA assays for GDNF and BDNF. GDNF and BDNF secretion of MSC-NTF cells of twelve different ALS patients in the Phase I/II clinical study is shown in FIGS. 6A-B. GDNF secretion was found to be induced on average 2-20 fold in MSC-NTF as compared to MSC, and BDNF secretion was found to be induced 1.5-5 fold in MSC-NTF as compared to MSC (n=10, FIGS. 6A-B). The differences in specific productivity are the results of patient to patient variability.

On the day before the end of differentiation and transplantation, GDNF secretion of MSC-NTF cells was found to be 54±12% of its secretion on the last day of differentiation and BDNF secretion of MSC-NTF cells was found to be 64±21% of its secretion on the last day of differentiation.

Figure 7:
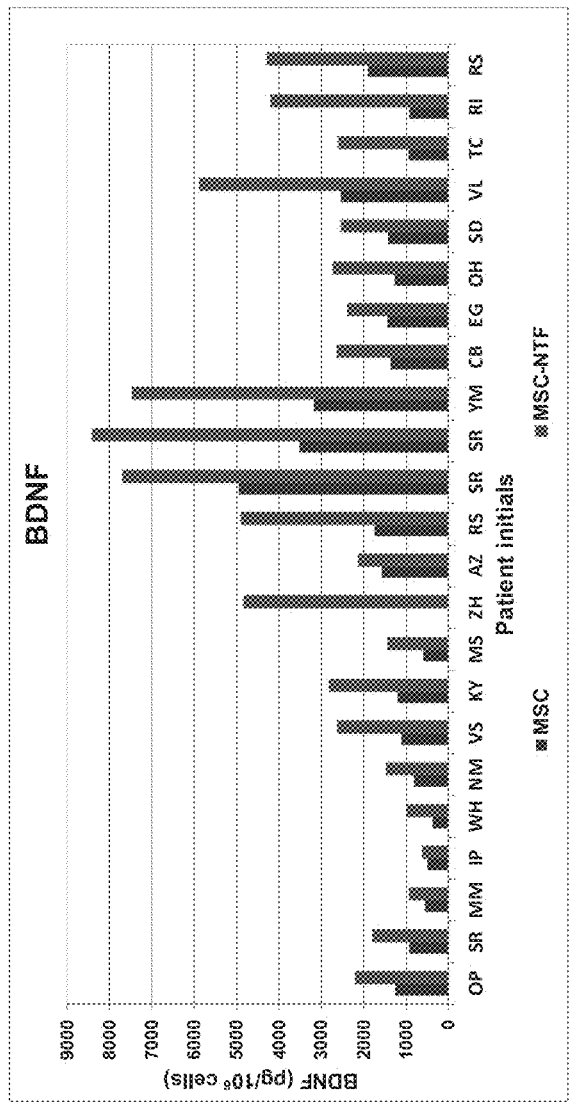
FIG. 7 is a graph is a graph illustrating BDNF productivity of MSC and MSC-NTF cells of 23 different ALS patients.

The assay was repeated on a larger sample of patients. BDNF secretion of MSC-NTF cells of 23 different ALS patients in the Phase I/II and the Phase IIa clinical studies is shown in FIG. 7. BDNF secretion was found to be induced on average 2.2±0.7 fold in MSC-NTF as compared to MSC (FIG. 7).

Figure 8:
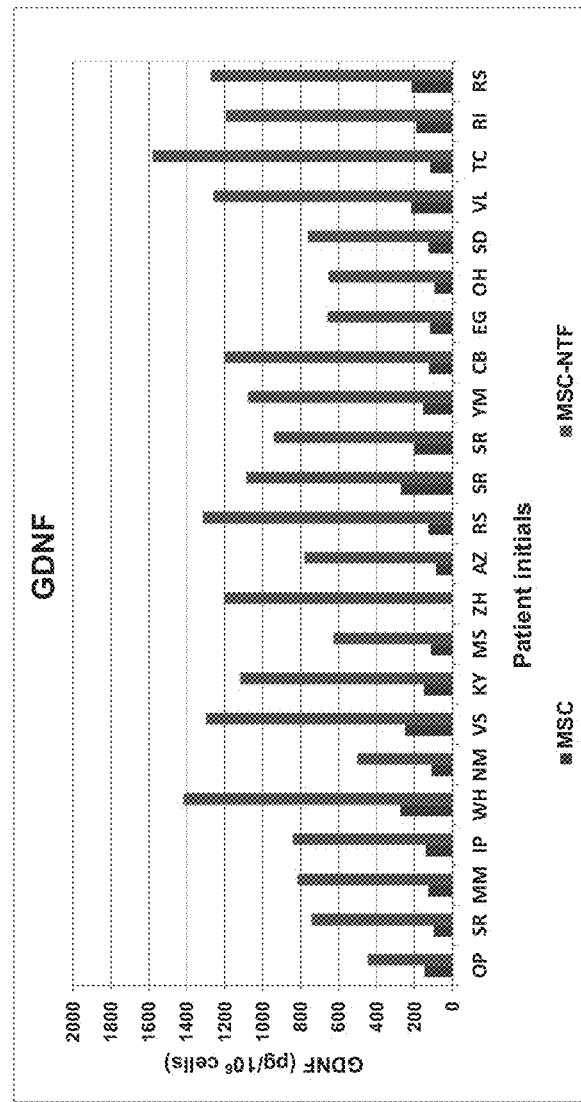
FIG. 8 is a graph is a graph illustrating GDNF productivity of MSC and MSC-NTF cells of 23 different ALS patients.

GDNF secretion of MSC-NTF cells of 23 different ALS patients in the Phase I/II and the Phase IIa clinical studies is shown in FIG. 8. GDNF secretion was found to be induced >6.6±2.4 fold in MSC-NTF as compared to MSC (FIG. 8). (Note: when GDNF expression was below the level of detection of the ELISA assay, a nominal value equivalent to the lowest limit of quantitation (23 pg/ml) is given to allow for calculations of fold induction. The results are therefore expressed as more than >).

On the day before the end of differentiation and transplantation, BDNF secretion of MSC-NTF cells was found to be 76±23% of its secretion on the last day of differentiation and GDNF secretion of MSC-NTF cells was found to be 66±18% of its secretion on the last day of differentiation.

TNF-alpha induced protein 6 (TSG-6) secretion was tested in 13 MSC and MSC-NTF culture supernatant samples using the ELISA kit from MyBioSource (USA).

All MSC and MSC-NTF culture supernatant samples tested were found to be negative for TSG-6.

Further MSC-NTF supernatant samples were found to be negative for insulin growth factor-1 (IGF-1) and nerve growth factor (NGF), as measured by ELISA using the ELISA Kit for IGF-1: human IGF-1 DuoSet Cat No. DY291; R&D System.

VEGF and HGF secretion was measured in MSC-NTFs generated by differentiating MSCs from ALS patients as described herein above. The ELISA assays for the respective cytokines were as follows (VEGF DuoSet R&D systems, Cat: DY293B and HGF DuoSet R&D systems, Cat: DY294). MSC-NTF cells were found to secrete high levels of VEGF and HGF with specific productivities in the range of 20-100 ng/$10^6$ cells (FIG. 9 and FIG. 10).

VEGF secretion of MSC-NTF cells of 22 different ALS patients in the Phase I/II and the Phase IIa clinical studies is shown in FIG. 9. VEGF secretion was found to be induced on average 4.1±1.4 fold in MSC-NTF as compared to MSC (FIG. 9). HGF secretion of MSC-NTF cells of 19 different ALS patients in the Phase I/II and the Phase IIa clinical studies is shown in FIG. 10. HGF secretion was found to be induced 6.7±3.9 fold in MSC-NTF as compared to MSC (FIG. 10). On the day before the end of differentiation and transplantation, VEGF secretion of MSC-NTF cells was found to be 69±25% of its secretion on the last day of differentiation and HGF secretion of MSC-NTF cells was found to be 79±31% of its secretion on the last day of differentiation (n=8).

Post Transplant Stability:

To evaluate the stability of NTFs secretion by MSC-NTF cells of ALS patients 'post-transplant' in vivo, MSC-NTF cells harvested at the end of differentiation were re-seeded in growth medium to simulate the 'post-transplant' in vivo scenario.

At the end of the three day-period, the cells were harvested and NTF secretion was compared to the secretion on the day the cells were initially harvested (after three days in differentiation medium Time '0').

MSC-NTF cells were found to maintain the level of NTF secretion also after three days culture in growth medium. In four independent experiments using cells of ALS patients, specific productivity of GDNF and BDNF of the MSC-NTF cells three day 'post-transplant' was found to be similar to the one at the time of harvest (FIGS. 11A-B).

Phenotypic Characterization of MSC-NTF Secreting Cells:

Phenotypic characterization of MSC-NTF secreting cells indicated that at the end of differentiation (day 3) they express all surface markers characteristic of MSC and do not express any of the MSC negative markers (FIGS. 12A-B).

Nevertheless some of the surface markers characteristic of MSC, were downregulated during differentiation into MSC-NTF cells. Downregulation of MSC surface markers has been previously shown for differentiation along the osteogenic, chondrogenic and adipogenic lineages (Jeong J A et al. 2007, Lee H J at al. 2009, Niehage C et al. 2011, Liu F at al, 2008). The expression of CD44 and CD73, characteristic MSC surface markers, was found to be modulated on the surface of MSC-NTF cells during differentiation. The expression of CD44, as determined by Mean Fluorescence Intensity (MFI) was found to be downregulated to 59% on MSC-NTF cells at the end of the differentiation process (day 3), as compared to its expression on MSCs analysed by flow cytometry on the same day and under identical instrument settings of the flow cytometer (FIGS. 13A-B and Table 5).

Using the same experimental approach, CD44 expression was found to be downregulated on MSC-NTF as compared to MSC, to a similar extent also on the day before the end of differentiation (MFI ratio of MSC-NTF/MSC is 0.67 on day 2, Table 3). As determined by MFI, expression of CD73, was found to be upregulated by 80% on MSC-NTF cells at the end of the differentiation process (day 3), as compared to its expression on MSCs, (FIGS. 13A-B and Table 3). CD73 expression was found to be upregulated on MSC-NTF to a similar extent also on the day before the end of differentiation (76%, day 2, Table 3). The modulated expression of CD44 and CD73 on the surface of MSC-NTF cells as compared to their expression on MSC cells of the same patient, analysed on the same day and under the same experimental conditions, is therefore a distinctive characteristic of MSC-NTF cells.

This expression pattern is characteristic of MSC-NTF cells both at the end of differentiation (on the day of transplantation, day 3), as well as on the day before the end of differentiation (day 2, Table 3), to approximately the same extent (Table 3), allowing the use of these surface markers for identification of MSC-NTF cells for transplantation.

Table 3, herein below summarizes the modulation of surface marker expression on MSC-NTF cell surface as compared to MSCs.

TABLE 3

MFI* (Ratio ± SD MSC-NTF/MSC)

| CD 73 | | CD 44 | | |
|---|---|---|---|---|
| p value | | p value | | |
| p < 0.05 | 1.76 ± 0.7 | p < 0.001 | 0.67 ± 0.1 | Day 2 |
| p < 0.001 | 1.80 ± 0.5 | p < 0.001 | 0.59 ± 0.2 | Day 3 |

Expression of CD 105 followed a different pattern during differentiation of MSC into MSC-NTF cells. On day 2, 95.8±4.2% (mean±standard deviation) of the MSC-NTF cells expressed CD 105 and the MFI of MSC-NTF cells was upregulated to an average of 1.36±0.26 (mean±standard deviation) as compared to MSC. On day 3 of differentiation only 73.6±13.8% (mean±standard deviation) of MSC-NTF expressed CD 105 whilst the MFI of the positive cells decreased to an average of 0.50±0.22 (mean±standard deviation, FIGS. 14A-B) as compared to its expression on MSC analysed by flow cytometry on the same day and under identical settings of the flow cytometer.

Table 4 herein below summarizes the expression of additional surface markers MSC-NTF cell surface as compared to MSCs.

| | | Results | |
|---|---|---|---|
| Marker | Characterization | MSC-NTF | MSC |
| CD 24 | Cell adhesion molecule | Negative | Negative |
| CD 133 | Stem/progenitor cell marker Prominin-1) | Negative | Negative |
| A2B5 | Stem Cell Marker Adhesion | Negative | Negative |
| CD 56 | Neural Cell Adhesion Molecule (NCAM) | ~7% positive | ~20% positive |
| CD 15 | Stage specific embryonic antigen-1 (Lex-1) | Negative | Negative |
| CD 184 | G-protein coupled receptor | Negative | Negative |
| CD 271 | Low-Affinity Nerve Growth Factor Receptor | Negative | Negative |
| CD29 | Integrin β1 (3 clones) | >95% positive | >95% positive |
| CD106 | Vascular Endothelial adhesion molecule (VCAM-1) | Negative | Negative |
| GLAST | Glutamate aspartate transporter | Negative | Negative |
| CD47 | Integrin associated protein | >95% positive | >95% positive |
| CD309 | Vascular endothelial growth factor receptor-2 (KDR/VEGFR-2) | Negative | Negative |
| MSCA-1 | Rapidly proliferating immature progenitor cells | ~65% positive | ~65% positive |

Cell Cycle Analysis:

The cell cycle distribution of the ALS patients' MSC-NTF secreting cells was analysed by flow cytometry and compared to cell cycle distribution of MSC of the same patient. The MSC-NTF secreting cells were found to be arrested in the $G_0/G_1$ phase of the cell cycle on the last day (day 3) of differentiation (FIGS. 15A-B) as well as on the day before the end of differentiation (Day 2, Table 5), as compared to MSC that displayed a distribution characteristic of cycling populations. These results indicate that MSC-NTF cells are not a cycling cell population.

TABLE 5

| | | % $G_0$-$G_1$ Average ± SD | | |
|---|---|---|---|---|
| | | MSC-NTF | MSC | |
| p < 0.001 | n = 13 | 87.4 ± 5 | 75.5 ± 2 | Day 2 |
| p < 0.001 | n = 13 | 86.9 ± 5 | 78.7 ± 4 | Day 3 |

Example 2

MiRNA Analysis of Mesenchymal Stem Cells that Secrete Neurotrophic Factors (MSC-NTF)

The objectives of the study were to perform microRNA-based (miRNA) fingerprinting to characterize bone-marrow-derived MSCs and MSC-NTF cells of 4 independent, matched donor samples by identifying differences and similarities between the miRNA expression profiles and identifying key miRNAs that define the differences between the two cell types and determine how they are represented (i.e. neural/astrocytic differentiation pathways, as well as BDNF, GDNF, and VEGF expression and signaling).

The study identified a total of 160 miRNAs which were reliably detected across all the samples the donor-to-donor variability evident via miRNA profiling was relatively low and Principal Component Analysis (PCA) revealed that sample set formed distinct clusters based on cell type.

Statistical comparisons of the miRNA profiles for the two different cell types identified 41 differentially-expressed (DE) key miRs.

19 were up-regulated in MSC-NTF relative to MSCs;
22 were down-regulated in MSC-NTF relative to MSCs.

Contextual analysis revealed that the differentially expressed miRNAs target mRNAs encoding proteins with functions in regulating VEGF signaling, neurogenesis and/or associated with a Neural Precursor Cell phenotype.

Materials and Methods

Sample Processing and Quality Control:

Total RNA was isolated from matched MSC and MSC-NTF pairs of 4 independent donor samples. RNA concentration was determined by Absorbance ratios (Abs) at 260/280 nm and 260/230 nm which were also determined as indicators of sample yield and purity. For all samples, further RNA QC was performed using the Agilent 2200 TapeStation and the ScreenTape R6K kit to determine the RNA Integrity Number (RIN).

Microarray Profiling:

Samples were analysed on the Agilent miRNA platform (using Agilent's SurePrint G3 Human v16 microRNA 8×60K microarray slides; miRBase version 16.0) One hundred nanograms of total RNA, from a working solution of 50 ng/µl in nuclease-free water, were used as input for each microarray experiment. Each slide contains 8 individual arrays, each array represents 1,349 microRNAs; 1205 Human (1199 verified as real miRNAs in miRbase 18) and 144 viral.

The four key steps of the microarray process were:
1. Labelling of RNA with single-colour, Cy3-based reagent.
2. Hybridisation of the labelled RNA samples to the microarray.
3. Wash steps.
4. Slide scanning, data capture and feature extraction (matching array spots to miRNA IDs) and quality control checks on the resultant image and data files.

Data Pre-Processing and QC:

The microarray data was normalised using pre-processing and data quality control (QC) methods. Array quality control was performed using outlier testing based on the following metrics:
average signal per array
average background per array
% present (% of miRNAs where expression is detected on each array)
principal components 1-3 from PCA (Jackson J E, 1991) of the full normalised sample set.

In addition, a sample-to-sample correlation analysis was performed on the normalised data set using Pearson's correlation metric. Outliers were identified using Grubbs' outlier test (Grubbs, 1969) with significance called at p<0.05.

Data Analysis

Overview of Detection Calls:

Detection calls (present or absent) for individual miRNAs were compared across the samples. The detection calls were calculated using the Agilent Feature Extraction (AFE) software version 10.7.3.1. A detailed description of how these calls are made is available in the Feature Extraction Reference Guide on the Agilent website.

Where the expression of miRNA was below the level of detection for the arrays, a nominal intensity value was given to these data points. This value (1.1375 on a log 2 scale and 2.2000 on a linear scale), was assigned to each undetected miRNA and was calculated during a normalisation process and was used to avoid errors arising from non-computable mathematical operations during subsequent data analyses. In addition, the normalisation methodology resulted in groups of miRNAs having very similar expression intensities being assigned the same average normalised intensity.

Summary Overview Visualisation of miRNA Expression Data:

A summary representation of the expression data was produced using PCA. PCA extracts the main effects from high-dimensional data such as microarray datasets, which for each sample have expression measurements from hundreds of miRNA. These main effects (principal components) can be displayed in a simplified graphical representation which retains the main properties of the data. The key point is that samples which have similar miRNA profiles cluster in the same space on the PCA plot. In addition, a heatmap was produced to visualise the expression levels and sample relationships. The clusters associated with the heatmap were derived from agglomerative hierarchical clustering using Euclidean distance with Ward linkage.

Hypothesis Testing:

Identification of equivalently-expressed (EE) and differentially-expressed (DE) miRNAs between the different sample groups and functional analysis of the DE miRNA sets. MiRNAs with equivalent expression levels (stably-expressed invariant markers) were identified using the Two One-Sided Tests (TOST) approach; see e.g. (Barker L E et al 2002) as paired tests. This approach is recommended for bioequivalence studies by the FDA (FDA guidance document, 2001). The miRNAs with max (pFDR)<0.05 from the lower and upper limits, respectively, were considered equivalently expressed. The expression level range (A) allowed for the equivalence corresponds to a fold-change of <1.5 in log 2-space.

The differences in miRNA expression between each cell group were evaluated by performing a paired Analysis of Variance (ANOVA) between the different cell groups. The p-values generated from the ANOVA were adjusted for multiple test inflation using the Benjamini-Hochberg method (Benjamini Y and Hochberg Y, 1995) and are referred to as pFDR. The miRNAs with significant differences from hypothesis testing at pFDR<0.05 as well as having an absolute fold-change (FC)≥1.5 were considered differentially expressed between a particular sample and the remaining samples. A p-value cut-off of 0.05 is common practice when analysing microarray data and the use of the fold-change threshold of 1.5 is based on the documented array-to-array variability from the Agilent system.

Functional (contextual) analysis was carried out by importing the list of differentially expressed (DE) miRNAs into GeneGo MetaCore™ (v6.14) and mapping them to their validated mRNA targets. In addition, a literature survey was conducted for selected DE miRNAs.

Results

The complete list of miRNAs detected across all 8 samples is given in Table 6, herein below.

TABLE 6

| miRNA.ID |
| --- |
| hsa-let-7a-5p |
| hsa-let-7b-5p |
| hsa-let-7c |
| hsa-let-7d-5p |
| hsa-let-7e-5p |
| hsa-let-7f-5p |
| hsa-let-7g-5p |
| hsa-let-7i-5p |
| hsa-miR-100-5p |
| hsa-miR-103b |
| hsa-miR-106a-5p |
| hsa-miR-106b-5p |
| hsa-miR-107 |
| hsa-miR-10a-5p |
| hsa-miR-10b-5p |
| hsa-miR-1181 |
| hsa-miR-1202 |
| hsa-miR-1207-5p |
| hsa-miR-1225-5p |

TABLE 6-continued

| miRNA.ID |
|---|
| hsa-miR-1228-3p |
| hsa-miR-1234 |
| hsa-miR-1246 |
| hsa-miR-125a-5p |
| hsa-miR-125b-5p |
| hsa-miR-1260a |
| hsa-miR-1260b |
| hsa-miR-1268b |
| hsa-miR-127-3p |
| hsa-miR-1275 |
| hsa-miR-1280 |
| hsa-miR-1305 |
| hsa-miR-130a-3p |
| hsa-miR-130b-3p |
| hsa-miR-132-3p |
| hsa-miR-136-5p |
| hsa-miR-137 |
| hsa-miR-140-3p |
| hsa-miR-140-5p |
| hsa-miR-143-3p |
| hsa-miR-145-5p |
| hsa-miR-146a-5p |
| hsa-miR-148a-3p |
| hsa-miR-150-3p |
| hsa-miR-151a-5p |
| hsa-miR-152 |
| hsa-miR-154-3p |
| hsa-miR-155-5p |
| hsa-miR-15a-5p |
| hsa-miR-15b-5p |
| hsa-miR-16-5p |
| hsa-miR-181a-5p |
| hsa-miR-181b-5p |
| hsa-miR-1915 |
| hsa-miR-193a-3p |
| hsa-miR-193a-5p |
| hsa-miR-193b-3p |
| hsa-miR-195-5p |
| hsa-miR-196a-5p |
| hsa-miR-196b-5p |
| hsa-miR-1973 |
| hsa-miR-199a-3p |
| hsa-miR-199a-5p |
| hsa-miR-199b-5p |
| hsa-miR-19a-3p |
| hsa-miR-19b-3p |
| hsa-miR-20a-5p |
| hsa-miR-20b-5p |
| hsa-miR-21-3p |
| hsa-miR-21-5p |
| hsa-miR-210 |
| hsa-miR-214-3p |
| hsa-miR-22-3p |
| hsa-miR-22-5p |
| hsa-miR-221-3p |
| hsa-miR-221-5p |
| hsa-miR-222-3p |
| hsa-miR-224-5p |
| hsa-miR-23a-3p |
| hsa-miR-23b-3p |
| hsa-miR-23b-5p |
| hsa-miR-24-3p |
| hsa-miR-25-3p |
| hsa-miR-26a-5p |
| hsa-miR-26b-5p |
| hsa-miR-27a-3p |
| hsa-miR-27b-3p |
| hsa-miR-2861 |
| hsa-miR-299-5p |
| hsa-miR-29a-3p |
| hsa-miR-29b-3p |
| hsa-miR-29c-3p |
| hsa-miR-30a-5p |
| hsa-miR-30b-5p |
| hsa-miR-30c-5p |
| hsa-miR-30d-5p |
| hsa-miR-30e-5p |
| hsa-miR-31-3p |
| hsa-miR-31-5p |
| hsa-miR-3132 |
| hsa-miR-3162-5p |
| hsa-miR-3195 |
| hsa-miR-3196 |
| hsa-miR-3198 |
| hsa-miR-320a |
| hsa-miR-320b |
| hsa-miR-320c |
| hsa-miR-320d |
| hsa-miR-320e |
| hsa-miR-324-3p |
| hsa-miR-331-3p |
| hsa-miR-337-5p |
| hsa-miR-342-3p |
| hsa-miR-34a-3p |
| hsa-miR-34a-5p |
| hsa-miR-34b-5p |
| hsa-miR-3529-3p |
| hsa-miR-361-5p |
| hsa-miR-3651 |
| hsa-miR-3656 |
| hsa-miR-3659 |
| hsa-miR-365b-3p |
| hsa-miR-3663-3p |
| hsa-miR-3665 |
| hsa-miR-3679-5p |
| hsa-miR-374a-5p |
| hsa-miR-374c-3p |
| hsa-miR-376a-3p |
| hsa-miR-376c |
| hsa-miR-377-3p |
| hsa-miR-381 |
| hsa-miR-409-3p |
| hsa-miR-424-5p |
| hsa-miR-4281 |
| hsa-miR-4284 |
| hsa-miR-4286 |
| hsa-miR-4291 |
| hsa-miR-4299 |
| hsa-miR-4324 |
| hsa-miR-4327 |
| hsa-miR-450a-5p |
| hsa-miR-455-3p |
| hsa-miR-487b |
| hsa-miR-493-5p |
| hsa-miR-494 |
| hsa-miR-495 |
| hsa-miR-503 |
| hsa-miR-574-3p |
| hsa-miR-574-5p |
| hsa-miR-630 |
| hsa-miR-638 |
| hsa-miR-642b-3p |
| hsa-miR-654-3p |
| hsa-miR-762 |
| hsa-miR-874 |
| hsa-miR-92a-3p |
| hsa-miR-93-5p |
| hsa-miR-939 |
| hsa-miR-940 |
| hsa-miR-99a-5p |
| hsa-miR-99b-5p |

PCA and Heatmap Visualisation of the Complete Sample Set:

To gain an overview of the donor-to-donor variability within each cell group and the relationships between the different cell groups, a visualisation of the complete dataset was produced by PCA using all 160 detected miRNAs. The PCA plot represents the information content (variance) of each complete microRNA-one dataset on the plot, as a single point in the principal component (PC) projection. The key point is the similar datasets cluster together.

This was initially done as a projection of the first 3 PCs (FIG. 16A). An alternative visualisation of the expression patterns for the miRNAs in each sample and the sample relationships was generated using a heatmap based on agglomerative hierarchical clustering (FIG. 16B).

The PCA and heatmap clustergram show that the sample set clearly separate forming two distinct clusters based on cell type.

Identification of Differentially-Expressed (DE) miRNAs

Hypothesis testing of the differences between groups was performed using a paired ANOVA, with significance called at pFDR<0.05 and FC≥1.5. Identification of DE miRNAs between the groups was carried out as described herein above.

Statistical comparisons of the miRNA profiles for the two cell types identified
41 DE (differentially-expressed) key miRNAs
19 were upregulated when comparing MSC-NTF vs MSC
22 were downregulated when comparing MSC-NTF vs MSC A summary of the expression profiles of the DE key miRNAs are shown in FIGS. 17 and 18. The 19 key miRNAs upregulated in MSC-NTF vs MSC are shown in FIG. 17 and for 22 key miRNAs downregulated in MSC-NTF vs MSC are shown in FIG. 18.

Contextual Analysis of the Selected DE miRNAs

To derive an overview of pathways affected by the miRNA DE profile for the MSC-NTFs, selected DE kmiRs™ were mapped to high-confidence experimentally-verified mRNA targets using GeneGO MetaCore™ and literature survey.

Angiogenesis:

A number of DE miRNAs were identified as being involved in regulating VEGF signaling and/or angiogenesis. MiRNA-503 was the most prominently downregulated miRNA in MSC-NTFs (8.4 fold), with expression being reduced to below the limit of detection in MSC-NTF 3, 5 and 7. Only MSC-NTF 2 had very low, but detectable expression—this is shown in FIG. 19, where, as an aid to visualise the fold change, the expression values have been converted to a linear scale.

In addition, a group of less profoundly downregulated miRNAs (1.5-2.0 fold) were also identified as directly targeting VEGF A (miR-145a, 20a-5p, miR-320a & 424-5p), VEGFR-2 (424-5p) FGF2 (424-5p) or being reported as being anti-angiogenic (miR-222-3p) (Poliseno et al 2006, Chamorro-Jorganes et al 2011, Anand 2013, Kim et al 2013).

Furthermore, miR-132-3p was highly upregulated, being strongly induced in MSC-NTFs (7.9 fold)—this is shown in FIG. 20 where again, as an aid to visualise the fold change, the expression values have been converted to a linear scale.

MiR-132-3p is pro-angiogenic, via inhibiting p120RasGAP a negative regulator of VEGF signaling. In addition, blocking miR-132-3p decreases angiogenesis (Anand 2013). In contrast, miR-34a-5p, an anti-angiogenic miRNA (Zhao et al 2010, Nails et al 2011) is highly expressed in both cell types, but is also upregulated in MSC-NTFs (4 fold) see FIG. 17 and FIG. 22B. However, miR-34a-5p also has a role in the neuronal cell differentiation and this effect may dominate over potential negative effects on angiogenesis discussed above.

Clearly, there are complex interacting pathways involving VEGF signaling in MSC-NTFs. On balance, however, taking this data together, especially the profound regulation of miR-503 and miR-132-3p, would suggest that VEGF signaling would be upregulated in MSC-NTFs leading to an enhancement of pro-angiogenic capacity in these cells in comparison to the MSCs—see FIG. 21.

Neural Precursor Cells (NPCs)/Neurogenesis:

A number of DE miRNAs were identified as being enriched/upregulated in NPCs and or neurones and being involved neurogenesis.

miR-132-3p was highly upregulated, being strongly induced in MSC-NTFs (7.9 fold)—see FIG. 17. MiR-132-3p plays an important role in neuronal development and maturation, and its expression is required for dendrite outgrowth and promotes dendritogenesis (in vitro and in vivo) by inhibiting p250GAP, a negative regulator of Rac and Cdc42 (Magill et al 2010).

MiR-762 was also strongly upregulated in MSC-NTFs (5.9 fold)—see FIG. 22A. MiR-762 is a neuronal-enriched miRNA and is upregulated during NPC differentiation from embryonic stem cells and plays a key role in this process (Zhang et al 2012).

MiR-34a-5p, is highly expressed in both cell types, and upregulated in MSC-NTFs (4 fold), see FIG. 22B. This miRNA is upregulated in NPCs derived from bone marrow MSCs where its elevation has been shown to promote neurite outgrowth and it a key regulator of neuronal differentiation (Agostini et al 2011, Chang et al 2011).

Overall, upregulation of these miRNAs in MSC-NTFs is consistent with these cells have a neuronal precursor phenotype with a differentiation trajectory towards neurons.

Highly Discriminatory DE miRNAs with No Known Biological Function May be Used as Candidate Surrogate Potency Markers:

A set of, highly-discriminatory miRNAs, with no currently validated mRNA targets were identified as being DE in MSC-NTFs (FIGS. 23A-E). These key miRs represent candidate identity/potency markers for MSC-NTFs. For miR-3659, expression levels were downregulated to below the limit of detection in 3 out of the 4 donors, only donor 2 had low, but detectable expression.

Example 3

Quantitative PCR Validation Study

Sample Processing and Quality Control:

All total RNA samples were checked for concentration, yield and quality of RNA. RNA QC was performed using Agilent 2200 TapeStation and the R6K Screen Tapes and Reagents following Sistemic's SOP (SSOP27) to determine RIN.

The 8 samples used in Phase I were previously checked for quantity and quality of RNA.

QPCR Profiling and Data Analysis:

QPCR was carried out using miRCURY LNA™ Universal RT microRNA PCR methodology and reagents (Exiqon A/S) following instruction manual v 5.1; Protocol A—Individual Assays. Briefly, cDNA was synthesised using 5 ng/ul of starting RNA template. An LNA™ RNA Spike-in control RNA was added to each sample. The expression levels of the candidate miRNAs (kmiRs™) were measured in technical triplicates for all samples of interest using miRNA specific primer sets.

A positive control (measures the expression of LNA™ RNA-Spike-in control) and 'no RNA template' and 'no reverse transcriptase (no RT)' negative controls were included for each of the tested samples. A negative 'no cDNA template' control was included for each of the tested miRNAs.

QPCR was carried out using LC480 LightCycler (Roche Ltd) and quantitation cycle (Cq) values were calculated by performing absolute quantification analysis using the second derivative maximum method.

Standard Curves and Efficiency Estimation:

The efficiency and linearity of the miRNA amplification process was evaluated where necessary using the standard curve approach (custom designed and not experimentally validated primers only). Serial dilutions of cDNA pooled from 8 MSC-NTF samples was run for hsa-miR-762 and hsa-miR-3663-3 in technical triplicates. The resulting Cq values were imported into Biogazelle gbase+ version 2.5; Hellemans J et al., 2007] to produce standard curves and calculate efficiency values.

Selection of Optimal miRNA Normalising Panel:

The expression levels of candidate invariant miRNAs were measured in technical triplicates for all 8 samples (Phase I). The resulting Cq values were imported into Biogazelle gbase+ version 2.5. Selection of the most stable subset of invariant markers (optimal number of normalisers and their identity) was performed using the GeNorm algorithm [Vandesompele J et al., 2002] as implemented in qbase+. A subset of invariant genes was considered as optimal and stable and, therefore suitable for normalisation if the geometrical mean of their GeNorm expression stability value (M-value) <0.5, pairwise variation between 2 sequential normalisation factors containing an increasing number of genes (V-value) <0.15 and coefficient of variation (Cv) <0.25. Normalising factor for each sample was then calculated as a geometric mean of the expression of chosen normalisers in this sample.

Data Pre-Processing:

The expression levels of miRNAs were measured in technical triplicates for all samples. The resulting Cq values were imported into Biogazelle's qbase+v 2.5. Cq values, where applicable were corrected for differences in amplification efficiency using the Pfaffl method [Pfaffl M W, 2001] and normalised using sample specific normalisation factors [Hellemans J et al., 2007]. Technical replicates were averaged and a Normalised Relative Quantity (NRQ) was determined for each miRNA and sample by calculating the ratio of the average Cq value against the geometric average of the selected invariant miRNAs (normalisation factor) [Hellemans J et al., 2007].

Statistical Analysis:

Differences in expression levels of miRNAs between sample groups were formally tested using paired t-tests. Differences were considered significant if the t-test p-value was less than 0.05.

List of miRNAs Analysed:

hsa-miR-22-3p; miR-19b-3p; hsa-miR-503, hsa-miR-320b, hsa-miR-424-5p, hsa-miR-34a-5p and hsa-miR-132-3p, hsa-miR-320a and miR-222-3p.

Results

Expression levels of hsa-miR-22-3p and hsa-miR-19b-3p were found to be identical in MSCs and MSC-NTFs. FIG. 24A illustrates that hsa-miR-503-5p is down-regulated in MSC-NTFs as compared to MSCs. FIG. 24B illustrates that hsa-miR-320b is down-regulated in MSC-NTFs as compared to MSCs. FIG. 24C illustrates that hsa-miR-424-5p is down-regulated in MSC-NTFs as compared to MSCs. FIG. 24D illustrates that hsa-miR-34a-5p is up-regulated in MSC-NTFs as compared to MSCs. FIG. 24E illustrates that hsa-miR-132-3p is up-regulated in MSC-NTFs as compared to MSCs. FIG. 24F illustrates that hsa-miR-320a is non-significantly down-regulated in MSC-NTFs as compared to MSCs. FIG. 24G illustrates that miR-222-3p is non-significantly down-regulated in MSC-NTFs as compared to MSCs.

Example 4

Protein Analysis of Mesenchymal Stem Cells that Secrete Neurotrophic Factors (MSC-NTF)

Materials and Methods

Proteolysis:

Proteins were extracted from the cell pellets in 9 M Urea, 400 mM Ammonium bicarbonate and 10 mM DTT and two cycles of sonication. 20 µg protein from each sample were reduced with 2.8 mM DTT (60° C. for 30 mM), modified with 8.8 mM iodoacetamide in 400 mM ammonium bicarbonate (in the dark, room temperature for 30 min) and digested in 2 M Urea, 25 mM ammonium bicarbonate with modified trypsin (Promega) at a 1:50 enzyme-to-substrate ratio, overnight at 37° C. An additional second trypsinization was performed for 4 hours.

Mass Spectrometry Analysis:

The tryptic peptides were desalted using C18 tips (Harvard) dried and re-suspended in 0.1% formic acid.

The peptides were resolved by reverse-phase chromatography on 0.075×180-mm fused silica capillaries (J&W) packed with Reprosil reversed phase material (Dr Maisch GmbH, Germany). The peptides were eluted with linear 180 minute gradient of 5 to 28% 5 minutes gradient of 28 to 95% and 25 minutes at 95% acetonitrile with 0.1% formic acid in water at flow rates of 0.15 µl/min. Mass spectrometry was performed by Q Exactive mass spectrometer (Thermo) in a positive mode using repetitively full MS scan followed by collision induced dissociation (CID) of the 10 most dominant ions selected from the first MS scan.

The mass spectrometry data from three biological repeats was analyzed using the MaxQuant software 1.3.0.5 (Mathias Mann's group) vs. the human section of the Uniprot database with 1% FDR. The data was quantified by label free analysis using the same software. The intensity data was transformed to log 2 in order to get a normal distribution. Missing values were replaced with 10.

T-Test with Permutation-based FDR, (with 250 randomization, Threshold value=0.05) between the A and the B groups was done using the Preseuse 1.3.0.4. Same software was used for additional annotations and data correlation.

Results 3622 proteins were identified in the project with at least 2 peptides. Although there are high similarities between the samples, correlation between the intensity profiles shows higher correlation between the samples of the same group.

Tables 7 and 8 herein below list the most differentially expressed proteins. (P-value below 0.05 with difference above 3 or below −3 and at least 2 identified peptides in at least two repeats). Negative values were replaced with 10. A=MSCs; B=differentiated MSCs.

TABLE 7

| | | | Average | Average exemplary | |
| | | Average in | in B | accession | |
| Name | symbol | A samples | samples | number | seq id no: |
| --- | --- | --- | --- | --- | --- |
| upregulated proteins in differentiated samples | | | | | |
| Isobutyryl-CoA dehydrogenase, mitochondrial | ACAD8 | 10 | 25 | Q9UKU7 | 42 |
| C—X—C motif chemokine 6 | CXCL6 | 10 | 28 | P80162 | 43 |
| Neuromodulin | GAP43 | 10 | 28 | P17677 | 44 |
| Growth/differentiation factor 15 | GDF15 | 10 | 29 | Q99988 | 45 |
| Hyaluronan synthase 1 | HAS1 | 10 | 28 | Q92839 | 46 |
| Interleukin-1 beta | IL1B | 10 | 32 | P01584 | 47 |
| Interleukin-8 | IL8 | 10 | 30 | P10145 | 48 |
| Inhibin beta A chain | INHBA | 10 | 27 | P08476 | 49 |
| Insulin receptor substrate 1 | IRS1 | 10 | 27 | P35568 | 50 |
| Integrin alpha-1 | ITGA1 | 10 | 28 | P56199 | 51 |
| Laccase domain-containing protein 1 | LACC1 | 10 | 29 | Q8IV20 | 52 |
| Laminin subunit alpha-4 | LAMA4 | 10 | 28 | Q16363 | 53 |
| Lumican | LUM | 10 | 27 | P51884 | 54 |
| Collagenase 3 | MMP13 | 10 | 26 | P45452 | 55 |
| Normal mucosa of esophagus-specific gene 1 protein | NMES1; C15orf48 | 10 | 27 | Q9C002 | 56 |
| Pre-B-cell leukemia transcription factor-interacting protein 1 | PBXIP1 | 10 | 29 | Q96AQ6 | 57 |
| Pleckstrin homology-like domain family A member 1 | PHLDA1 | 10 | 28 | Q8WV24 | 58 |
| Phosphatidylinositol 3,4,5-trisphosphate-dependent Rac exchanger 1 protein | PREX1 | 10 | 26 | Q8TCU6 | 59 |
| Prostaglandin E synthase | PTGES | 10 | 32 | O14684 | 60 |
| Prostaglandin G/H synthase 2 | PTGS2 | 10 | 31 | P35354 | 61 |
| Ras-related protein Rab-27B | RAB27B | 10 | 28 | O00194 | 62 |
| Rho-related GTP-binding protein RhoB | RHOB | 10 | 27 | P62745 | 63 |
| Sialate O-acetylesterase | SIAE | 10 | 26 | Q9HAT2 | 64 |
| Monocarboxylate transporter 7 | SLC16A6 | 10 | 27 | O15403 | 65 |
| Tissue factor pathway inhibitor 2 | TFPI2 | 10 | 30 | P48307 | 66 |
| Transmembrane protein 65 | TMEM65 | 10 | 26 | Q6PI78 | 67 |
| Vam6/Vps39-like protein | VPS39 | 10 | 26 | Q96JC1 | 68 |
| 3-oxo-5-beta-steroid 4-dehydrogenase | AKR1D1 | 14 | 28 | P51857 | 69 |
| Propionyl-CoA carboxylase beta chain, mitochondrial | PCCB | 15 | 28 | P05166 | 70 |
| Interferon regulatory factor 2-binding protein-like | IRF2BPL | 15 | 28 | Q9H1B7 | 71 |
| Tissue alpha-L-fucosidase | FUCA1 | 14 | 27 | P04066 | 72 |
| Aldo-keto reductase family 1 member C2 | AKR1C2 | 24 | 29 | P52895 | 73 |
| Inositol 1,4,5-trisphosphate receptor-interacting protein | ITPRIP | 26 | 30 | Q8IWB1 | 74 |
| Protein KIAA1199 | KIAA1199 | 28 | 31 | Q8WUJ3 | 75 |
| Selenium-binding protein 1 | SELENBP1 | 27 | 31 | Q13228 | 76 |
| Phospholipase D3 | PLD3 | 27 | 31 | Q8IV08 | 77 |
| GTP: AMP phosphotransferase, mitochondrial | AK3 | 28 | 31 | Q9UIJ7 | 78 |
| Protein Wnt-5a; Protein Wnt | WNT5A | 28 | 31 | P41221 | 79 |
| Aldo-keto reductase family 1 member C3 | AKR1C3 | 25 | 31 | P42330 | 80 |
| Sorting nexin-9 | SNX9 | 28 | 31 | Q9Y5X1 | 81 |
| Gap junction alpha-1 protein | GJA1 | 28 | 32 | P17302 | 82 |
| Pyruvate carboxylase, mitochondrial | PC | 27 | 32 | P11498 | 83 |
| SH3 and PX domain-containing protein 2B | SH3PXD2B | 28 | 32 | A1X283 | 84 |
| Integrin alpha-2 | ITGA2 | 28 | 32 | P17301 | 85 |
| Cytochrome P450 1B1 | CYP1B1 | 27 | 33 | Q16678 | 86 |
| Chitinase-3-like protein 1 | CHI3L1 | 15 | 33 | P36222 | 87 |

TABLE 7-continued upregulated proteins in differentiated samples

| Name | symbol | Average in A samples | Average in B samples | exemplary accession number | seq id no: |
|---|---|---|---|---|---|
| Nicotinamide phosphoribosyltransferase | NAMPT; RP11-92J19.4 | 30 | 34 | P43490 | 88 |
| Seprase | FAP | 30 | 33 | Q12884 | 89 |
| Superoxide dismutase | SOD2 | 27 | 34 | P04179 | 90 |
| Aldo-keto reductase family 1 member C1 | AKR1C1 | 29 | 34 | Q04828 | 91 |
| FERM, RhoGEF and pleckstrin domain-containing protein 1 | FARP1 | 25 | 28 | Q9Y4F1 | 92 |
| Prolyl 4-hydroxylase subunit alpha-3 | P4HA3 | 24 | 28 | Q7Z4N8 | 93 |
| Ribonucleoside-diphosphate reductase subunit M2 B | RRM2B | 25 | 29 | Q7LG56 | 94 |
| Core histone macro-H2A.2; Histone H2A | H2AFY2 | 26 | 29 | Q9P0M6 | 95 |
| Choline transporter-like protein 1 | SLC44A1 | 26 | 29 | Q8WWI5 | 96 |
| Niemann-Pick C1 protein | NPC1 | 25 | 30 | O15118 | 97 |
| Lysosomal alpha-glucosidase | GAA | 27 | 31 | P10253 | 98 |

TABLE 8 down regulated proteins in differentiated samples

| Protein names | Gene names | Average in A samples | Average in B samples | exemplary accession number | seq id no: |
|---|---|---|---|---|---|
| Tight junction protein ZO-2 | TJP2 | 24 | 10 | Q9UDY2 | 99 |
| Alpha-1,3-mannosyl-glycoprotein 2-beta-N-acetylglucosaminyltransferase | MGAT1 | 26 | 10 | P26572 | 100 |
| Smoothelin | SMTN | 26 | 10 | P53814 | 101 |
| Ectopic P granules protein 5 homolog | EPG5 | 25 | 10 | Q9HCE0 | 102 |
| BRCA1-associated ATM activator 1 | BRAT1 | 25 | 14 | Q6PJG6 | 103 |
| WD repeat-containing protein 36 | WDR36 | 26 | 10 | Q8NI36 | 104 |
| SH3 domain-binding protein 4 | SH3BP4 | 26 | 10 | Q9P0V3 | 105 |
| EH domain-binding protein 1-like protein 1 | EHBP1L1 | 26 | 10 | Q8N3D4 | 106 |
| Ras GTPase-activating-like protein IQGAP3 | IQGAP3 | 26 | 10 | Q86VI3 | 107 |
| Lysyl oxidase homolog 2 | LOXL2 | 26 | 10 | Q9Y4K0 | 108 |
| Tropomyosin 1 (Alpha), isoform CRA_f | TPM1 | 27 | 10 | Q6ZN40 | 109 |
| Gem-associated protein 5 | GEMIN5 | 27 | 10 | Q8TEQ6 | 110 |
| Tripartite motif-containing protein 16 | TRIM16; CDRT1 | 27 | 10 | O95361 | 111 |
| Connective tissue growth factor | CTGF | 28 | 10 | P29279 | 112 |
| Lymphokine-activated killer T-cell-originated protein kinase | PBK | 26 | 10 | Q96KB5 | 113 |
| Tetratricopeptide repeat protein 4 | TTC4 | 27 | 10 | Q5TA95 | 114 |
| Breast cancer anti-estrogen resistance protein 1 | BCAR1 | 28 | 10 | P56945 | 115 |
| Ribonucleoside-diphosphate reductase subunit M2 | RRM2 | 27 | 10 | P31350 | 116 |
| Ubiquitin-conjugating enzyme E2 C | UBE2C | 27 | 10 | O00762 | 117 |
| Neutrophil defensin 1; HP 1-56; Neutrophil defensin 2; Neutrophil defensin 3; HP 3-56; Neutrophil defensin 2 | DEFA1; DEFA3 | 28 | 10 | P59665 | 118 |

TABLE 8-continued down regulated proteins in differentiated samples

| Protein names | Gene names | Average in A samples | Average in B samples | exemplary accession number | seq id no: |
|---|---|---|---|---|---|
| Cdc42 effector protein 3 | CDC42EP3 | 27 | 10 | Q9UKI2 | 119 |
| Condensin complex subunit 2 | NCAPH | 27 | 10 | Q15003 | 120 |
| Ig kappa chain C region | IGKC | 28 | 10 | P01834 | 121 |
| Condensin complex subunit 3 | NCAPG | 28 | 10 | Q9BPX3 | 122 |
| Syncoilin | SYNC | 27 | 14 | Q9H7C4 | 123 |
| Structural maintenance of chromosomes protein 2 | SMC2 | 29 | 15 | O95347 | 124 |
| Condensin complex subunit 1 | NCAPD2 | 29 | 10 | Q15021 | 125 |
| Inter-alpha-trypsin inhibitor heavy chain H4; 70 kDa inter-alpha-trypsin inhibitor heavy chain H4; 35 kDa inter-alpha-trypsin inhibitor heavy chain H4 | ITIH4 | 29 | 15 | Q14624 | 126 |
| Thymidylate synthase | TYMS; TS | 29 | 10 | P04818 | 127 |
| Serotransferrin | TF | 30 | 10 | P02787 | 128 |
| Pregnancy zone protein | PZP | 29 | 15 | P20742 | 129 |
| DNA replication licensing factor MCM7 | MCM7 | 30 | 15 | P33993 | 130 |
| Hemopexin | HPX | 31 | 15 | P02790 | 131 |
| DNA mismatch repair protein Msh6 | MSH6 | 27 | 23 | P52701 | 132 |
| Ankyrin repeat domain-containing protein 13A | ANKRD13A | 27 | 23 | Q8IZ07 | 133 |
| Phosducin-like protein 3 | PDCL3 | 27 | 24 | Q9H2J4 | 134 |
| 1-phosphatidylinositol 4,5-bisphosphate phosphodiesterase beta-3 | PLCB3 | 27 | 24 | Q01970 | 135 |
| Complement C3; Complement C3 beta chain; Complement C3 alpha chain; C3a anaphylatoxin; Complement C3b alpha chain; Complement C3c alpha chain fragment 1; Complement C3dg fragment; Complement C3g fragment; Complement C3d fragment; Complement C3f fragment; Complement C3c alpha chain fragment 2 | C3 | 28 | 25 | P01024 | 136 |
| DNA replication licensing factor MCM3 | MCM3 | 30 | 25 | P25205 | 137 |
| CD97 antigen; CD97 antigen subunit alpha; CD97 antigen subunit beta | CD97 | 27 | 24 | P48960 | 138 |
| DNA replication licensing factor MCM6 | MCM6 | 31 | 25 | Q14566 | 139 |
| DNA replication licensing factor MCM4 | MCM4 | 30 | 25 | P33991 | 140 |
| Disabled homolog 2 | DAB2 | 29 | 26 | P98082 | 141 |
| Protein KIAA0664 | KIAA0664 | 28 | 25 | O75153 | 142 |
| DNA replication licensing factor MCM2 | MCM2 | 30 | 27 | P49736 | 143 |
| Protein-lysine 6-oxidase | LOX | 29 | 25 | P28300 | 144 |
| Ribonucleoside-diphosphate reductase large subunit; Ribonucleoside-diphosphate reductase | RRM1 | 29 | 26 | P23921 | 145 |
| Melanoma-associated antigen D2 | MAGED2 | 30 | 26 | Q9UNF1 | 146 |
| Ig gamma-1 chain C region | IGHG1 | 29 | 26 | P01857 | 147 |
| Heparanase; Heparanase 8 kDa subunit; Heparanase 50 kDa subunit | HPSE | 29 | 26 | Q9Y251 | 148 |
| Importin subunit alpha-2 | KPNA2 | 30 | 27 | P52292 | 149 |
| Asparagine synthetase [glutamine-hydrolyzing] | ASNS | 31 | 28 | P08243 | 150 |
| Alpha-2-macroglobulin | A2M | 35 | 27 | P01023 | 151 |
| Collagen alpha-1(I) chain | COL1A1 | 35 | 28 | P02452 | 152 |
| Collagen alpha-1(V) chain | COL5A1 | 32 | 29 | P20908 | 153 |
| DnaJ homolog subfamily B member 4 | DNAJB4 | 31 | 28 | Q9UDY4 | 154 |

TABLE 8-continued down regulated proteins in differentiated samples

| Protein names | Gene names | Average in A samples | Average in B samples | exemplary accession number | seq id no: |
|---|---|---|---|---|---|
| Thrombospondin-1 | THBS1 | 33 | 29 | P07996 | 155 |
| Serum albumin | ALB | 33 | 29 | P02768 | 156 |
| Collagen alpha-2(I) chain | COL1A2 | 34 | 29 | P08123 | 157 |

Example 5

A Phase I/II, Open Label Clinical Study to Evaluate the Safety, Tolerability and Therapeutic Effects of Transplantation of Autologous Cultured Mesenchymal Bone Marrow Stromal Cells Secreting Neurotrophic Factors (MSC-NTF), in Patients with Amyotrophic Lateral Sclerosis (ALS)

Study Objectives:
to evaluate the safety, tolerability and therapeutic effects (preliminary efficacy) of injection of autologous cultured mesenchymal bone marrow stromal cells secreting neurotrophic factors (MSC-NTF), as treatment for patients with Amyotrophic Lateral Sclerosis (ALS) at the early and progressive disease stages.

Primary Endpoints:
1. Safety evaluation and tolerability of a single treatment administration of autologous cultured mesenchymal bone marrow stromal cells secreting neurotrophic factors (MSC-NTF) by multiple intramuscular injections (IM) at 24 separate sites on the biceps and triceps muscles with a total of ~24×10$^6$ cells, to patients with ALS at the early disease stage.

2. Safety evaluation and tolerability of single intrathechal injection (IT) into the cerebrospinal fluid (CSF) of a total of ~60×10$^6$ autologous cultured mesenchymal bone marrow stromal cells secreting neurotrophic factors (MSC-NTF), to patients with ALS at the progressive disease stage.

Secondary Endpoints:
Change in the ALS functional rating scale (ALS-FRS-R).
Change in muscle strength grading (MVIC) by muscle chart and optional by grip.
Changes in forced vital capacity (FVC %) (In the progressive disease stage group only).
Changes in muscle bulk estimated by MRI of the upper and lower extremities.
Changes in upper and lower extremities circumference (cm)
Changes in EMG parameters
Need and time to tracheotomy or permanent assisted ventilation.
Overall survival, calculating time to death.

Number of Subjects:
A total of 12 subjects—6 at the ALS early stage and 6 at the ALS progressive disease stage.

Study Design:
This is a phase I/II prospective, open label, two patient-group clinical study, to evaluate the safety, tolerability and preliminary efficacy of autologous cultured mesenchymal bone marrow stromal cells secreting neurotrophic factors (MSC-NTF), as a potent treatment for patients with Amyotrophic Lateral Sclerosis (ALS) at the early and progressive disease stages. This study is a single center trial.

All patients enrolled will have a documented history of ALS disease prior to study enrolment. Patients diagnosed as early stage ALS disease with duration of less than 6 months and patients diagnosed with progressive stage ALS disease with duration of 6-12 months. ALS patients identified as "predisposed" will be approached and requested to sign an Informed Consent Form (ICF). Overall, 12 patients will be recruited and allocated based on their ALS disease severity to 2 treatment groups:
Group A—6 patients of early ALS disease stage
Group B—6 patients of progressive ALS disease The expected duration of patient screening period prior to enrollment into this study is in-between two weeks up to 2 days prior to the study enrollment day during visit 2 (verification of compliance with inclusion/exclusion criteria including clinical laboratory results). Eligible patients will be enrolled into the study and will be observed for every 2 weeks during a "run in period" of 3 months for determination of the progression rate of the disease (allowing a time window of ±5 days for all visits). During the "run in period" after about 6 weeks following enrollment, patients of both study groups will undergo a Bone Marrow Aspiration (BMA) procedure and MSC-NTF cells will be produced from the bone marrow aspirate based on the presently disclosed method. On the last "run in period" visit, patients of both study groups will undergo the treatment and MSC-NTF will be transplanted by IM or IT injection to the early and progressive ALS patients respectively.

After the MSC-NTF transplantation patients will be observed on a monthly basis for a post treatment follow up period of 6 months (allowing a time window of ±5 days for all visits). Treatment safety, adverse events and exploratory parameters, to establish ALS progression rate assessment of the disease will be recorded throughout the duration of the "run in period" and the post treatment follow up period.

Study Duration:
Overall, under the study protocol, each patient will undergo a total of 13 visits during study duration of about 9 months.

Treatment Doses:
As detailed in Table 9, herein below.

TABLE 9

| | Group A - ALS Early stage | Group B - ALS Progressive stage |
|---|---|---|
| Number of subjects | 6 | 6 |
| Route of administration | IM | IT |
| NTF cell concentration for transplantation | ~5 × 10$^3$ cells/μl | ~30 × 10$^3$ cells/μl |
| NTF cell number injected/point | ~1 × 10$^6$ cells | ~6 × 10$^6$ cells |
| Number of injection points | 24 | 1 |
| Total number of cells/patient | ~24 × 10$^6$ cells | ~60 × 10$^6$ cells |
| Cell volume/injection | 200 μl | 2 ml |
| Total number of syringes | 24 | 1 |

TABLE 9-continued

|  | Group A - ALS Early stage | Group B - ALS Progressive stage |
| --- | --- | --- |
| Syringe size and type (BD) | 1 ml Luer-Lock 309628 | 3 ml Luer-Lock 309578 |

Results

MSC-NTF treatment either by IM or IT administration was safe and well tolerated during the 6 monthly follow-up visits. No significant treatment-related adverse events were observed in the 12 treated patients by either route of administration. Two out of six patients experienced bruising and fever following IM administration and three out of six patients experienced headache, neck stiffness and fever following IT administration.

As illustrated in FIG. 25, the ALS Functional Rating Score (ALSFRS-R) for the IT treated patients showed a more moderate monthly rate of decline after treatment than before treatment: the slope improved from −1.5 over three months to 0.08 over six months.

As illustrated in FIG. 26, the Forced Vital capacity (FVC) for the IT treated patients showed a more moderate monthly rate of decline after treatment than before treatment: the slope improved from −0.107 over three months to −0.06 over six months.

As illustrated in FIG. 27, muscle circumference also showed a similarly positive trend. These differences did not reach statistical significance probably due to the small number of patients.

Example 6

A Phase IIa, Open Label, Dose-Escalating Clinical Study to Evaluate the Safety, Tolerability and Therapeutic Effects of Transplantation of Autologous Cultured Mesenchymal Bone Marrow Stromal Cells Secreting Neurotrophic Factors (MSC-NTF), in Patients with Amyotrophic Lateral Sclerosis (ALS)

Study Objectives:

The study objectives are to evaluate the safety, tolerability and therapeutic effects (preliminary efficacy) of co-administered intrathecally and intramuscularly injection of escalating doses of autologous cultured mesenchymal bone marrow stromal cells secreting neurotrophic factors (MSC-NTF), as a treatment for patients with Amyotrophic Lateral Sclerosis (ALS) at the early disease stages.

Primary Endpoints:

Safety evaluation and tolerability of a single treatment administration of autologous cultured mesenchymal bone marrow stromal cells secreting neurotrophic factors (MSC-NTF) administered in an escalating low, medium and high dose ($94 \times 10^6$, $141 \times 10^6$, and $188 \times 10^6$ respectively) by multiple intramuscular injections (IM) at 24 separate sites on the biceps and triceps, in addition to a single intrathecal injection (IT) into the cerebrospinal fluid (CSF) to patients with ALS at the early disease stage.

Secondary Endpoints:

Change in the ALS functional rating scale (ALS-FRS-R).

Change in muscle strength grading (MVIC) by grip.

Changes in % forced vital capacity (FVC)

Changes in muscle bulk estimated by MRI of the upper extremities.

Changes in upper and lower extremities circumference (cm)

Changes in EMG parameters

Number of Subjects:

A total of 12 Subjects at the ALS early disease stage.

Study Design:

This is a phase IIa prospective, open label, dose-escalating, three patient-group clinical study, to evaluate the safety, tolerability and preliminary efficacy of autologous cultured mesenchymal bone marrow stromal cells secreting neurotrophic factors (MSC-NTF), as a potent treatment for patients with Amyotrophic Lateral Sclerosis (ALS) at the early disease stages. This study is a single center trial.

All patients enrolled will have a documented history of ALS disease prior to study enrolment. Patients diagnosed as early stage ALS disease with duration of less than 2 years. ALS patients identified as "predisposed" will be approached and requested sign an Informed Consent Form (ICF). Overall, 12 patients will be recruited.

Treatment will start with the lowest dose ($94 \times 10^6$ cells) and the dose will be increased to the next medium and high dose ($141 \times 10^6$ and $188 \times 10^6$ respectively), for the next patients group only following safety analysis.

The expected duration of patient screening period prior to enrollment into this study is in-between two weeks up to 2 days prior to the study enrollment day during visit 2 (verification of compliance with inclusion/exclusion criteria including clinical laboratory results). Eligible patients will be enrolled into the study and will be observed for every month during a "run in period" of 3 months for determination of the progression rate of the disease (allowing a time window of ±5 days for all visits). During the "run in period" after about 6 weeks following enrollment, patients of both study groups will undergo a Bone Marrow Aspiration (BMA) procedure and MSC-NTF cells will be produced from the bone marrow aspirate based on Brainstorm Cell Therapeutics Ltd proprietary method. On the last "run in period" visit, patients will undergo the treatment and MSC-NTF will be transplanted by IM+IT to the early ALS patients.

After the MSC-NTF transplantation patients will be observed on a monthly basis for a post treatment follow up period of 6 months (allowing a time window of ±5 days for all visits). Treatment safety, adverse events and exploratory parameters, to establish ALS progression rate assessment of the disease will be recorded throughout the duration of the "run in period" and the post treatment follow up period.

Study Duration:

Overall, under the study protocol, each patient will undergo a total of 10 visits during study duration of about 9 months.

Treatment Doses: As Detailed in Table 10, Herein Below.

TABLE 10

|  | Group A - Low Dose | Group B - Medium Dose | Group C - High Dose |
| --- | --- | --- | --- |
| Number of subjects | 4 | 4 | 4 |
| Route of administration | IM + IT | IM + IT | IM + IT |

TABLE 10-continued

| | | Group A - Low Dose | Group B - Medium Dose | Group C - High Dose |
|---|---|---|---|---|
| Dose IM | | $1 \times 10^6$ cells | $1.5 \times 10^6$ cells | $2 \times 10^6$ cells |
| No. of injection sites | | 24 | 24 | 24 |
| Dose IT (average 70 Kg) | | $1 \times 10^6$ cells/Kg body weight | $1.5 \times 10^6$ cells/Kg body weight | $2 \times 10^6$ cells/Kg body weight |
| No. of injection sites | | 1 | 1 | 1 |
| Cell concentration/dose | IM Volume | $5 \times 10^6$ cells/ml 200 µl/site | $7.5 \times 10^6$ cells/ml 200 µl/site | $10 \times 10^6$ cells/ml 200 µl/site |
| Total IM dose | | $24 \times 10^6$ cells | $36 \times 10^6$ cells | $48 \times 10^6$ cells |
| Cell concentration/dose | IT Volume | $17.5 \times 10^6$ cells/ml 4 ml | $26.25 \times 10^6$ cells/ml 4 ml | $35 \times 10^6$ cells/ml 4 ml |
| Total IT dose | | $70 \times 10^6$ cells | $105 \times 10^6$ cells | $140 \times 10^6$ cells |
| Total cell dose | | $94 \times 10^6$ cells | $141 \times 10^6$ cells | $188 \times 10^6$ cells |

Efficacy Assessment:

MSC-NTF treatment preliminary efficacy assessment will be based on observation of the following variables along the study post-treatment follow up period: ALS functional rating scale (ALS-FRS-R), muscle strength grading (MVIC) by grip, % forced vital capacity (FVC %), muscle bulk estimated by MRI of the upper extremities, upper and lower extremities circumference (cm), EMG parameters.

Safety Assessment:

Subject safety will be assessed following treatment by the MSC-NTF, using measurements of the following variables:
Physical examination,
Vital Signs (HR, BP, RR, Body temperature),
Clinical laboratory parameters:
CBC—RBC with Indices, WBC with differential and platelet count, hemoglobin (Hb) and hematocrit (Ht)
Coagulation functions—ProThrombin time (PT), INR, Partial thromboplastin time (PTT), Fibrinogen
Blood Chemistry for electrolytes (sodium, potassium, calcium, magnesium, chloride), glucose, total protein, triglycerides (TG), Total cholesterol, HDL, LDL
Kidney function (urea, creatinine,)
Hepatic function (total bilirubin, AST(GOT), ALT(GPT), ALP)
Urinalysis (dip-stick test)—Specific Gravity, pH, glucose, protein, ketons, blood
Adverse events recording and
Concomitant medications Statistical Analysis:

All data obtained in this study and documented in the CRFs will be listed and tabulated with descriptive group statistics (mean, standard deviation, minimum, maximum, number of valid cases), as appropriate. Statistical processing and calculation will be done in parallel for the three patient groups. For discrete variables such as sex, status, number of Adverse Events (occurrence, severity, relationship with IP), etc., frequencies, percents and distributions will be computed. The results between the three groups will be compared and analyzed by statistical analysis.

A paired t-test will be used to compare changes in efficacy parameters from baseline.

Further data analysis will be made as appropriate. Each statistical test will be analyzed with a 0.05 significance level: $p \leq 0.05$ means significant result, $p > 0.05$ means not significant result.

Example 6

Comparing the Yield of MSC-NTFs Obtained Using a One-Step or Two-Step Protocol

Materials and Methods

One Step Protocol: as described in Example 1.

Two Step Protocol: Human MSC (12,000 cells/cm$^2$) were seeded in PM containing low glucose DMEM, L-Glutamine sodium pyruvate, heparin and platelet lysate. Two days later the medium was replaced with low glucose DMEM supplemented with 2 mM L-Glutamine (Biological industries), 20 ng/ml human epidermal growth factor (hEGF), 20 ng/ml human basic fibroblast growth factor (hbFGF) (R&D Systems) and N2 supplement (Invitrogen). After 72 hours, the medium was replaced with DMEM supplemented with 1 mM dibutyryl cyclic AMP (dbcAMP), 0.5 mM isobutylmethylxanthine (IBMX) (Sigma-Aldrich), 5 ng/ml human platelet derived growth factor (PDGF), 50 ng/ml human neuregulin 1-β1/HRG1-β1 EGF domain and 20 ng/ml hbFGF (all from R&D Systems) for 3 more days.

Results

As illustrated in FIGS. 28A-C, the one step protocol resulted in a significantly higher yield of MSC-NTFs, as compared to the yield obtained using the two-step protocol, as shown in three different patient samples, that enabled to establish a viable manufacturing production process able of supporting the clinical trial in patients, at the dose outlined in Examples 1 and 6.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as

REFERENCES

Agostini M, Tucci P, Steinert J R, Shalom-Feuerstein R, Rouleau M, Aberdam D, Forsythe I D, Young K W, Ventura A, Concepcion C P, Han Y C, Candi E, Knight R A, Mak T W, Melino G (2011). microRNA-34a regulates neurite outgrowth, spinal morphology, and function. *Proc Natl Acad Sci USA*. 108(52):21099-104.

Anand S (2013). A brief primer on microRNAs and their roles in angiogenesis. *Vasc Cell*. 5(1):2.

Barker L E, Luman E T, McCauley M M, Chu S Y (2002). Assessing equivalence: an alternative to the use of difference tests for measuring disparities in vaccination coverage. Am J Epidemiol. 156(11):1056-61.

Benjamini Y and Hochberg Y (1995). Controlling the false discovery rate: a practical and powerful approach to multiple testing. *J Royal Stat Soc B,* 57:289-300.

Caporali A, Emanueli C (2011). MicroRNA-503 and the extended microRNA-16 family in angiogenesis. *Trends Cardiovasc Med*. 21(6):162-6.

Chamorro-Jorganes A, Araldi E, Penalva L O, Sandhu D, Fernandez-Hernando C, Suarez Y (2011). MicroRNA-16 and microRNA-424 regulate cell-autonomous angiogenic functions in endothelial cells via targeting vascular endothelial growth factor receptor-2 and fibroblast growth factor receptor-1. *Arterioscler Thromb Vasc Biol*. 31(11): 2595-606.

Chang S J, Weng S L, Hsieh J Y, Wang T Y, Chang M D, Wang H W (2011). MicroRNA-34a modulates genes involved in cellular motility and oxidative phosphorylation in neural precursors derived from human umbilical cord mesenchymal stem cells. *BMC Med Genomics*. 4:65.

FDA guidance document "Statistical Approaches to Establishing Bioequivalence" (2001). fdadotgov/downloads/Drugs/GuidanceComplianceRegulatoryInformation/Guidances/ucm070244

Grubbs, F (1969). Procedures for Detecting Outlying Observations in Samples, *Technometrics,* 11:1-21.

Jackson J E. (1991). A User's Guide to Principal Components, New York: John Wiley & Sons Kim J, Kang Y, Kojima Y, Lighthouse J K, Hu X, Aldred M A, McLean D L, Park H, Comhair S A, Greif D M, Erzurum S C, Chun H J (2013). An endothelial apelin-FGF link mediated by miR-424 and miR-503 is disrupted in pulmonary arterial hypertension. *Nat Med*. 19(1):74-82.

Leeper N J, Cooke J P (2011). MicroRNA and mechanisms of impaired angiogenesis in diabetes mellitus. *Circulation*. 123(3):236-8.

Magill S T, Cambronne X A, Luikart B W, Lioy D T, Leighton B H, Westbrook G L, Mandel G, Goodman R H (2010). microRNA-132 regulates dendritic growth and arborization of newborn neurons in the adult hippocampus. *Proc Natl Acad Sci USA*. 107(47):20382-7.

Nails D, Tang S N, Rodova M, Srivastava R K, Shankar S (2011). Targeting epigenetic regulation of miR-34a for treatment of pancreatic cancer by inhibition of pancreatic cancer stem cells. *PLoS One*. 6(8):e24099.

Poliseno L, Tuccoli A, Mariani L, Evangelista M, Citti L, Woods K, Mercatanti A, Hammond S, Rainaldi G (2006). MicroRNAs modulate the angiogenic properties of HUVECs. *Blood*. 108(9):3068-71.

Presta M, Dell'Era P, Mitola S, Moroni E, Ronca R, Rusnati M (2005). Fibroblast growth factor/fibroblast growth factor receptor system in angiogenesis. *Cytokine Growth Factor Rev*. 16(2): 159-78.

Zhang D, Zhao T, Ang H S, Chong P, Saiki R, Igarashi K, Yang H, Vardy L A (2012). AMD1 is essential for ESC self-renewal and is translationally down-regulated on differentiation to neural precursor cells. *Genes Dev*. 26(5): 461-73.

Zhao T, Li J, Chen A F (2010). MicroRNA-34a induces endothelial progenitor cell senescence and impedes its angiogenesis via suppressing silent information regulator 1. *Am J Physiol Endocrinol Metab*. 299(1):E110-6. Zheng K, Li H, Huang H, Qiu M (2012). MicroRNAs and glial cell development. *Neuroscientist*. 18(2):114-8.

Zhou B, Ma R, Si W, Li S, Xu Y, Tu X, Wang Q (2013). MicroRNA-503 targets FGF2 and VEGFA and inhibits tumor angiogenesis and growth. *Cancer Lett*. 333(2):159-69.

SEQUENCE LISTING (157 sequences)

SEQ ID NO: 1 - RNA, 23 nt, Homo sapiens
ugagcaccacacaggccgggcgc

SEQ ID NO: 2 - RNA, 22 nt, Homo sapiens
uaacagucuacagccauggucg

SEQ ID NO: 3 - RNA, 22 nt, Homo sapiens
ggggcuggggccggggccgagc

SEQ ID NO: 4 - RNA, 19 nt, Homo sapiens
ggcuugcaugggggacugg

SEQ ID NO: 5 - RNA, 18 nt, Homo sapiens
agcaggugcggggcggcg

SEQ ID NO: 6 - RNA, 22 nt, Homo sapiens
uggcagugucuuagcugguugu

SEQ ID NO: 7 - RNA, 20 nt, Homo sapiens
ccccagggcgacgcggcggg

SEQ ID NO: 8 - RNA, 22 nt, Homo sapiens
caaucagcaaguauacugcccu

SEQ ID NO: 9 - RNA, 23 nt, Homo sapiens
uaggcagugucauuagcugauug

SEQ ID NO: 10 - RNA, 22 nt, Homo sapiens
cugcccuggcccgagggaccga

SEQ ID NO: 11 - RNA, 23 nt, Homo sapiens
cggccccacgcaccaggguaaga

SEQ ID NO: 12 - RNA, 18 nt, Homo sapiens
gggucccggggagggggg

SEQ ID NO: 13 - RNA, 21 nt, Homo sapiens
uggcagggaggcugggagggg

SEQ ID NO: 14 - RNA, 22 nt, Homo sapiens
uguaaacauccuacacucagcu

SEQ ID NO: 15 - RNA, 23 nt, Homo sapiens
uagcaccauuugaaaucaguguu

SEQ ID NO: 16 - RNA, 23 nt, Homo sapiens
cccaguguuuagacuaucuguuc

SEQ ID NO: 17 - RNA, 22 nt, Homo sapiens
uguaaacauccuugacuggaag

SEQ ID NO: 18 - RNA, 22 nt, Homo sapiens
uucaaguaauccaggauaggcu

SEQ ID NO: 19 - RNA, 20 nt, Homo sapiens
cccugagacccuaaccuuaa

SEQ ID NO: 20 - RNA, 23 nt, Homo sapiens
uagcagcgggaacaguucugcag

SEQ ID NO: 21 - RNA, 21 nt, Homo sapiens
ugaguguugucuacgagggca

SEQ ID NO: 22 - RNA, 24 nt, Homo sapiens
aacaacaaaaucacuagucuucca

SEQ ID NO: 23 - RNA, 22 nt, Homo sapiens
aaaagcuggguugagagggcaa

SEQ ID NO: 24 - RNA, 17 nt, Homo sapiens
gugggggagaggcuguc

SEQ ID NO: 25 - RNA, 24 nt, Homo sapiens
uggguagagaaggagcucagagga

SEQ ID NO: 26 - RNA, 22 nt, Homo sapiens
gaaguugcccauguuauuuucg

SEQ ID NO: 27 - RNA, 23 nt, Homo sapiens
aacauucauugcugucggugggu

SEQ ID NO: 28 - RNA, 22 nt, Homo sapiens
cagcagcaauucauguuuugaa

SEQ ID NO: 29 - RNA, 18 nt, Homo sapiens
gggcucacaucaccccau

SEQ ID NO: 30 - RNA, 23 nt, Homo sapiens
ugagugugugugugugagugugu

SEQ ID NO: 31 - RNA, 21 nt, Homo sapiens
ugagaugaagcacuguagcuc

SEQ ID NO: 32 - RNA, 23 nt, Homo sapiens
aaaagugcuuacagugcagguag

SEQ ID NO: 33 - RNA, 21 nt, Homo sapiens
gcaguccaugggcauauacac

SEQ ID NO: 34 - RNA, 23 nt, Homo sapiens
uaaagugcuuauagugcagguag

SEQ ID NO: 35 - RNA, 23 nt, Homo sapiens
guccaguuuucccaggaaucccu

SEQ ID NO: 36 - RNA, 20 nt, Homo sapiens
acugccccaggugcugcugg

SEQ ID NO: 37 - RNA, 22 nt, Homo sapiens
cagugcaaugaugaaagggcau

SEQ ID NO: 38 - RNA, 22 nt, Homo sapiens
uuuucaacucuaaugggagaga

SEQ ID NO: 39 - RNA, 21 nt, Homo sapiens
uaccacaggguagaaccacgg

SEQ ID NO: 40 - RNA, 22 nt, Homo sapiens
aaaagcuggguugagagggcga

SEQ ID NO: 41 - RNA, 21 nt, Homo sapiens
agcuacaucuggcuacugggu

SEQ ID NO: 42 - protein, 415 aa, Homo sapiens
MLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 43 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 44 - protein, 238 aa, Homo sapiens
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 45 - protein, 308 aa, Homo sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 46 - protein, 578 aa, Homo sapiens
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 47 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 48 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 49 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 50 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 51 - protein, 1179 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 52 - protein, 430 aa, Homo sapiens
MAEAVLIDLFGLKLNSQKNCHQTLLKTLNAVQYHHAAKAKFLCIMCCSNISYERDGEQDNCEIETSNGLSALLEEFEIVSCPSMAATLYTIKQKIDEKNLSSIKVIVPRHRKTLMKAFIDQLFTDVYNFEFEDLQVTFRGGLFKQSIEINVITAQELRGIQNEIETFLRSLPALRGKLTIITSSLIPDIFIHGFTTRTGGISYIPTLSSFNLFSSSKRRDPKVVVQENLRRLANAAGFNVEKFYRIKTHHSNDIWIMGRKEPDSYDGITTNQRGVTIAALGADCIPIVFADPVKKACGVAHAGWKGTLLGVAMATVNAMIAEYGCSLEDIVVVLGPSVGPCCFTLPRESAEAFHNLHPACVQLFDSPNPCIDIRKATRILLEQGGILPQNIQDQNQDLNLCTSCHPDKFFSHVRDGLNFGTQIGFISIKE

SEQ ID NO: 53 - protein, 1823 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDALRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 54 - protein, 338 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 55 - protein, 471 aa, Homo sapiens
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 56 - protein, 83 aa, Homo sapiens
MSFFQLLMKRKELIPLVVFMTVAAGGASSFAVYSLWKTDVILDRKKNPEPWETVDPTVPQKLITINQQWKPIEELQNVQRVTK

SEQ ID NO: 57 - protein, 731 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 58 - protein, 401 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 59 - protein, 1659 aa, Homo sapiens
MEAPSGSEPGGDGAGDCAHPDPRAPGAAAPSSGPGPCAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 60 - protein, 152 aa, Homo sapiens
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 61 - protein, 604 aa, Homo sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 62 - protein, 218 aa, Homo sapiens
MTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGIPYFETSAATGQNVEKAVETLLDLIMKRMEQCVEKTQIPDTVNGGNSGNLDGEKPPEKKCIC

SEQ ID NO: 63 - protein, 196 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 64 - protein, 523 aa, Homo sapiens
MVAPGLVLGLVLPLILWADRSAGIGFRFASYINNDMVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 65 - protein, 523 aa, Homo sapiens
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 66 - protein, 235 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 67 - protein, 240 aa, Homo sapiens
MSRLLPLLRSRTARSLRPGPAAAAAPRPPSWCCCGRGLLALAPPGGLPGGPRRLGTHPKKEPMEALNTAQGARDFIYSLHSTERSCLLKELHRFESIAIAQEKLEAPPPTPGQLRYVFIHNAIPFIGFGFLDNAIMIVAGTHIEMSIGIILGISTMAAAALGNLVSDLAGLGLAGYVEALASRLGLSIPDLTPKQVDMWQTRLSTHLGKAVGVTIGCILGMFPLIFFGGGEEDEKLETKS

SEQ ID NO: 68 - protein, 886 aa, Homo sapiens
MHDAFEPVPILEKLPLQIDCLAAWEEWLLVGTKQGHLLLYRIRKDVVPADVASPESGSCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 69 - protein, 326 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 70 - protein, 539 aa, Homo sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 71 - protein, 796 aa, Homo sapiens
MSAAQVSSSRRQSCYLCDLPRMPWAMIWDFSEPVCRGCVNYEGADRIEFVIETARQLKRAHGCFQDGRSPGPPPPVGVKTVALSAKEAAAAAAAAAAAAAAAQQQQQQQQQQQQQQQQQQQQQQQQQLNHVDGSSKPAVLAAPSGLERYGLSAAAAAAAAAAAAVEQRSRFEYPPPPVSLGSSSHTARLPNGLGGPNGFPKPTPEEGPPELNRQSPNSSSAAASVASRRGTHGGLVTGLPNPGGGGGPQLTVPPNLLPQTLLNGPASAAVLPPPPPHALGSRGPPTPAPPGAPGGPACLGGTPGVSATSSSASSSTSSSVAEVGVGAGGKRPGSVSSTDQERELKEKQRNAEALAELSESLRNRAEEWASKPKMVRDTLLTLAGCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRFFKEGVPGADMLPQPYLDASCPMLPTALVSLSRAPSAPPGTGALPPAAPSGRGAAASLRKRKASPEPPDSAEGALKLGEEQQRQQWMANQSEALKLTMSAGGFAAPGHAAGGPPPPPPPLGPHSNRTTPPESAPQNGPSPMAALMSVADTLGTAHSPKDGSSVHSTTASARRNSSSPVSPASVPGQRRLASRNGDLNLQVAPPPPSAHPGMDQVHPQNIPDSPMANSGPLCCTICHERLEDTHFVQCPSVPSHKFCFPCSRESIKAQGATGEVYCPSGEKCPLVGSNVPWAFMQGEIATILAGDVKVKKERDP

SEQ ID NO: 72 - protein, 466 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 73 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 74 - protein, 547 aa, Homo sapiens
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGLGGAPLQGLTLPNKATLGHFYERCIRGATADAARTREFLEGFVDDLLEALRSLCNRDTDMEVEDFIGVDSMYENWQVDRPLLCHLFVPFTPPEPYRFHPELWCSGRSVPLDRQGYGQIKVVRADGDTLSCICGKTKLGEDMLCLLHGRNSMAPPCGDMENLLCATDSLYLDTMQVMKWFQTALTRAWKGIAHKYEFDLAFGQLDSPGSLKIKFRSGKFMPFNLIPVIQCDDSDLYFVSHLPREPSEGTPASSTDWLLSFAVYERHFLRTTLKALPEGACHLSCLQIASFLLSKQSRLTGPSGLSSYHLKTALLHLLLLRQAADWKAGQLDARLHELLCFLEKSLLQKKLHHFFIGNRKVPEAMGLPEAVLRAEPLNLFRPFVLQRSLYRKTLDSFYEMLKNAPALISEYSLHVPSDQPTPKS

SEQ ID NO: 75 - protein, 1361 aa, Homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 76 - protein, 472 aa, Homo sapiens
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 77 - protein, 490 aa, Homo sapiens
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 78 - protein, 227 aa, Homo sapiens
MGASARLLRAVIMGAPGSGKGTVSSRITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 79 - protein, 380 aa, Homo sapiens
MKKSIGILSPGVALGMAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 80 - protein, 323 aa, Homo sapiens
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 81 - protein, 595 aa, Homo sapiens
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 82 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 83 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 84 - protein, 911 aa, Homo sapiens
MPPRRSIVEVKVLDVQKRRVPNKHYVYIIRVTWSSGSTEAIYRRYSKFFDLQMQMLDKFPMEGGQKDPKQRIIPFLPGKILFRRSHIRDVAVKRLIPIDEYCKALIQLPPYISQCDEVLQFFETRPEDLNPPKEEHIGKKKSGGDQTSVDPMVLEQYVVVANYQKQESSEISLSVGQVVDIIEKNESGWWFVSTAEEQGWVPATCLEGQDGVQDEFSLQPEEEEKYTVIYPYTARDQDEMNLERGAVVEVIQKNLEGWWKIRYQGKEGWAPASYLKKNSGEPLPPKPGPGSPSHPGALDLDGVSRQQNAVGREKELLSSQRDGRFEGRPVPDGDAKQRSPKMRQRPPPRRDMTIPRGLNLPKPPIPPQVEEEYYTIAEFQTTIPDGISFQAGLKVEVIEKNLSGWWYIQIEDKEGWAPATFIDKYKKTSNASRPNFLAPLPHEVTQLRLGEAAALENNTGSEATGPSRPLPDAPHGVMDSGLPWSKDWKGSKDVLRKASSDMSASAGYEEISDPDMEEKPSLPPRKESIIKSEGELLERERERQRTEQLRGPTPKPPGVILPMMPAKHIPPARDSRRPEPKPDKSRLFQLKNDMGLECGHKVLAKEVKKPNLRPISKSKTDLPEEKPDATPQNPFLKSRPQVRPKPAPSPKTEPPQGEDQVDICNLRSKLRPAKSQDKSLLDGEGPQAVGGQDVAFSRSFLPGEGPGRAQDRTGKQDGLSPKEISCRAPPRPAKTTDPVSKSVPVPLQEAPQQRPVVPPRRPPPPKKTSSSSRPLPEVRGPQCEGHESRAAPTPGRALLVPPKAKPFLSNSLGGQDDTRGKGSLGPWGTGKIGENREKAAAASVPNADGLKDSLYVAVADFEGDKDTSSFQEGTVFEVREKNSSGWWFCQVLSGAPSWEGWIPSNYLRKKP

SEQ ID NO: 85 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 86 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 87 - protein, 383 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 88 - protein, 491 aa, Homo sapiens [sequence omitted]

SEQ ID NO: 89 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 90 - protein, 222 aa, Homo sapiens [sequence omitted]

SEQ ID NO: 91 - protein, 323 aa, Homo sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 92 - protein, 1045 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 93 - protein, 544 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 94 - protein, 351 aa, Homo sapiens
MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 95 - protein, 372 aa, Homo sapiens
MSGRSGKKKMSKLSRSARAGVIFPVGRLMRYLKKGTFKYRISVGAPVYMAAVIEYLAAEILELAGNAARDNKKARIAPRHILLAVANDEELNQLLKGVTIASGGVLPRIHPELLAKKRGTKGKSETILSPPPEKRGRKATSGKKGGKKSKAAKPRTSKKSKPKDSDKEGTSNSTSEDGPGDGFTILSSKSLVLGQKLSLTQSDISHIGSMRVEGIVHPTTAEIDLKEDIGKALEKAGGKEFLETVKELRKSQGPLEVAEAAVSQSSGLAAKFVIHCHIPQWGSDKCEEQLEETIKNCLSAAEDKKLKSVAFPPFPSGRNCFPKQTAAQVTLKAISAHFDDSSASSLKNVYFLLFDSESIGIYVQEMAKLDAK

SEQ ID NO: 96 - protein, 657 aa, Homo sapiens
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 97 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 98 - protein, 952 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPVEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 99 - protein, 1190 aa, Homo sapiens
MPVRGDRGFPPRRELSGWLRAPGMEELIWEQYTVTLQKDSKRGFGIAVSGGRDNPHFENGETSIVISDVLPGGPADGLLQENDRVVMVNGTPMEDVLHSFAVQQLRKSGKVAAIVVKRPRKVQVAALQASPPLDQDDRAFEVMDEFDGRSFRSGYSERSRLNSHGGRSRSWEDSPERGRPHERARSRERDLSRDRSRGRSLERGLDQDHARTRDRSRGRSLERGLDHDFGPSRDRDRDRSRGRSIDQDYERAYHRAYDPDYERAYSPEYRRGARHDARSRGPRSRSREHPHSRSPSPEPRGRPGPIGVLLMKSRANEEYGLRLGSQIFVKEMTRTGLATKDGNLHEGDIILKINGTVTENMSLTDARKLIEKSRGKLQLVVLRDSQQTLINIPSLNDSDSEIEDISEIESNRSFSPEERRHQYSDYDYHSSSEKLKERPSSREDTPSRLSRMGATPTPFKSTGDIAGTVVPETNKEPRYQEDPPAPQPKAAPRTFLRPSPEDEAIYGPNTKMVRFKKGDSVGLRLAGGNDVGIFVAGIQEGTSAEQEGLQEGDQILKVNTQDFRGLVREDAVLYLLEIPKGEMVTILAQSRADVYRDILACGRGDSFFIRSHFECEKETPQSLAFTRGEVFRVVDTLYDGKLGNWLAVRIGNELEKGLIPNKSRAEQMASVQNAQRDNAGDRADFWRMRGQRSGVKKNLRKSREDLTAVVSVSTKFPAYERVLLREAGFKRPVVLFGPIADIAMEKLANELPDWFQTAKTEPKDAGSEKSTGVVRLNTVRQIIEQDKHALLDVTPKAVDLLNYTQWFPIVIFFNPDSRQGVKTMRQRLNPTSNKSSRKLFDQANKLKKTCAHLFTATINLNSANDSWFGSLKDTIQHQQGEAVWVSEGKMEGMDDDPEDRMSYLTAMGADYLSCDSRLISDFEDTDGEGGAYTDNELDEPAEEPLVSSITRSSEPVQHEESIRKPSPEPRAQMRRAASSDQLRDNSPPPAFKPEPPKAKTQNKEESYDFSKSYEYKSNPSAVAGNETPGASTKGYPPPVAAKPTFGRSILKPSTPIPPQEGEEVGESSEEQDNAPKSVLGKVKIFEKMDHKARLQRMQELQEAQNARIEIAQKHPDIYAVPIKTHKPDPGTPQHTSSRPPEPQKAPSRPYQDTRGSYGSDAEEEEYRQQLSEHSKRGYYGQSARYRDTEL

SEQ ID NO: 100 - protein, 445 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN

SEQ ID NO: 101 - protein, 917 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAEMLVDCVPLVEVDDMMIMGKKPDPKCVFTYVQSLYNHLRRHELRLRGKNV

SEQ ID NO: 102 - protein, 2579 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 103 - protein, 821 aa, Homo sapiens
MDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 104 - protein, 951 aa, Homo sapiens
MCCTEGSLRKRDSQRAPEAVLCLQLWQRTVPLDTLKGLGTCFPSGPELRGAGIAAAMERASERRTASALFAGFRALGLFSNDIPHVVRFSALKRRFYVTTCVGKSFHTYDVQKLSLVAVSNSVPQDICCMAADGRLVFAAYGNVFSAFARNKEIVHTFKGHKAEIHFLQPFGDHIISVDTDGILIIWHIYSEEEYLQLTFDKSVFKISAILHPSTYLNKILLGSEQGSLQLWNVKSNKLLYTFPGWKVGVTALQQAPAVDVVAIGLMSGQVIIHNIKFNETLMKFRQDWGPITSISFRTDGHPVMAAGSPCGHIGLWDLEDKKLINQMRNAHSTAIAGLTFLHREPLLVTNGADNALRIWIFDGPTGEGRLLRFRMGHSAPLTNIRYYGQNGQQILSASQDGTLQSFSTVHEKFNKSLGHGLINKKRVKRKGLQNTMSVRLPPITKFAAEEARESDWDGIIACHQGKLSCSTWNYQKSTIGAYFLKPKELKKDDITATAVDITSCGNFAVIGLSSGTVDVYNMQSGIHRGSFGKDQAHKGSVRGVAVDGLNQLTVTTGSEGLLKFWNFKNKILIHSVSLSSSPNIMLLHRDSGILGLALDDFSISVLDIETRKIVREFSGHQGQINDMAFSPDGRWLISAAMDCSIRTWDLPSGCLIDCFLLDSAPLNVSMSPTGDFLATSHVDHLGIYLWSNISLYSVVSLRPLPADYVPSIVMLPGTCQTQDVEVSEETVEPSDELIEYDSPEQLNEQLVTLSLLPESRWKNLLNLDVIKKKNKPKEPPKVPKSAPFFIPTIPGLVPRYAAPEQNNDPQQSKVVNLGVLAQKSDFCLKLEEGLVNNKYDTALNLLKESGPSGIETELRSLSPDCGGSIEVMQSFLKMIGMMLDRKRDFELAQAYLALFLKLHLKMLPSEPVLLEEITNLSSQVEENWTHLQSLFNQSMCILNYLKSALL

SEQ ID NO: 105 - protein, 963 aa, Homo sapiens
MAAQRIRAANSNGLPRCKSEGTLIDLSEGFSETSFNDIKVPSPSALLVDNPTPFGNAKEVIAIKDYCPTNFTTLKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPAPVALQLWGKHQFVLSRPQDLKVCMFSNMTNYEVKASEQAKVVRGFQLKLGKVSRLIFPITSQNPNELSDFTLRVQVKDDQEAILTQFCVQTPQPPPKSAIKPSGQRRFLKKNEVGKIILSPFATTTKYPTFQDRPVSSLKFGKLLKTVVRQNKNHYLLEYKKGDGIALLSEERVRLRGQLWTKEWYIGYYQGRVGLVHTKNVLVVGRARPSLCSGPELSTSVLLEQILRPCKFLTYIYASVRTLLMENISSWRSFADALGYVNLPLTFFCRAELDSEPERVASVLEKLKEDCNNTENKERKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 106 - protein, 1523 aa, Homo sapiens
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPVRLRLKPKSVKVVQAELSLTLSGVLLREGRATDDDMQSLASLMSVKPSDVGNLDDFAESDEDEAHGPGAPEARARVPQPDPSRELKTLCEEEEEGQGRPQQAVASPSNAEDTSPAPVSAPAPPARTSRGQGSERANEAGGQVGPEAPRPPETSPEMRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKVRHVDTKGPEATGVMPEARCRGTPEAPPRGSQGRLGVRTRDEAPSGLSLPPAEPAGHSGQLGDLEGARAAAGQEREGAEVRGGAPGIEGTGLEQGPSVGAISTRPQVSSWQGALLSTAQGAISRGLGGWEAEAGGSGDLETETEVVGLEVLGTQEKEVEGSGFPETRTLEIEILGALEKEAARSRVLESEVAGTAQCEGLETQETEVGVIETPGTETEVLGTQKTEAGGSGVLQTRTTIAETEVLVTQEISGDLGPLKIEDTIQSEMLGTQETEVEASRVPESEAEGTEAKILGTQEITARDSGVREIEAEIAESDILVAQEIEVGLLGVLGIETGAAEGAILGTQEIASRDSGVPGLEADTTGIQVKEVGGSEVPEIATGTAETEILGTQEIASRSSGVPGLESEVAGAQETEVGGSGISGPEAGMAEARVLMTRKTEIIVPEAEKEEAQTSGVQEAETRVGSALKYEALRAPVTQPRVLGSQEAKAEISGVQGSETQVLRVQEAEAGVWGMSEGKSGAWGAQEAEMKVLESPENKSGTFKAQEAEAGVLGNEKGKEAEGSLTEASLPEAQVASGAGAGAPRASSPEKAEEDRRLPGSQAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEGLVNGAGAPGGGGVRLRRPSVNGEPGSVPPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 107 - protein, 1631 aa, Homo sapiens
MERRAAGPGWAAYERLTAEEMDEQRRQNVAYQYLCRLEEAKRWMEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSNMASELAKYGLQLPAFSKIGGILANELSVDEAAVHAAVLAINEAVERGVVEDTLAALQNPSALLENLREPLAAVYQEMLAQAKMEKAANARNHDDRESQDIYDHYLTQAEIQGNINHVNVHGALEVVDDALERQSPEALLKALQDPALALRGVRRDFADWYLEQLNSDREQKAQELGLVELLEKEEVQAGVAAANTKGDQEQAMLHAVQRINKAIRRRVAADTVKELMCPEAQLPPVYPVASSMYQLELAVLQQQQGELGQEELFVAVEMLSAVVLINRALEARDASGFWSSLVNPATGLAEVEGENAQRYFDALLKLRQERGMGEDFLSWNDLQATVSQVNAQTQEETDRVLAVSLINEALDKGSPEKTLSALLLPAAGLDDVSLPVAPRYHLLLVAAKRQKAQVTGDPGAVLWLEEIRQGVVRANQDTNTAQRMALGVAAINQAIKEGKAAQTERVLRNPAVALRGVVPDCANGYQRALESAMAKKQRPADTAFWVQHDMKDGTAYYFHLQTFQGIWEQPPGCPLNTSHLTREEIQSAVTKVTAAYDRQQLWKANVGFVIQLQARLRGFLVRQKFAEHSHFLRTWLPAVIKIQAHWRGYRQRKIYLEWLQYFKANLDAIIKIQAWARMWAARRQYLRRLHYFQKNVNSIVKIQAFFRARKAQDDYRILVHAPHPPLSVVRRFAHLLNQSQQDFLAEAELLKLQEEVVRKIRSNQQLEQDLNIMDIKIGLLVKNRITLQEVVSHCKKLTKRNKEQLSDMMVLDKQKGLKSLSKEKRQKLEAYQHLFYLLQTQPIYLAKLIFQMPQNKTTKFMEAVIFSLYNYASSRREAYLLLQLFKTALQEEIKSKVEQPQDVVTGNPTVVRLVVRFYRNGRGQSALQEILGKVIQDVLEDKVLSVHTDPVHLYKNWINQTEAQTGQRSHLPYDVTPEQALSHPEVQRRLDIALRNLLAMTDKFLLAITSSVDQIPYGMRYVAKVLKATLAEKFPDATDSEVYKVVGNLLYYRFLNPAVVAPDAFDIVAMAAGGALAAPQRHALGAVAQLLQHAAAGKAFSGQSQHLRVLNDYLEETHLKFRKFIHRACQVPEPEERFAVDEYSDMVAVAKPMVYITVGELVNTHRLLLEHQDCIAPDHQDPLHELLEDLGELPTIPDLIGESIAADGHTDLSKLEVSLTLTNKFEGLEADADDSNTRSLLLSTKQLLADIIQFHPGDTLKEILSLSASREQEAAHKQLMSRRQACTAQTPEPLRRHRSLTAHSLLPLAEKQRRVLRNLRRLEALGLVSARNGYQGLVDELAKDIRNQHRHRHRRKAELVKLQATLQGLSTKTTFYEEQGDYYSQYIRACLDHLAPDSKSSGKGKKQPSLHYTAAQLLEKGVLVEIEDLPASHFRNVIFDITPGDEAGKFEVNAKFLGVDMERFQLHYQDLLQLQYEGVAVMKLFNKAKVNVNLLIFLLNKKFLRK

SEQ ID NO: 108 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 109 - protein, 326 aa, Homo sapiens
MDAIKKKMQMLKLDKENALDRAEQAEADKKAAEDRSKQLEEDIAAKEKLLRVSEDERDRVLEELHKAEDSLLAAEEAAAKLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 110 - protein, 1508 aa, Homo sapiens
MGQEPRTLPPSPNWYCARCSDAVPGGLFGFAARTSVFLVRVGPGAGESPGTPPFRVIGELVGHTERVSGFTFSHHPGQYNLCATSSDDGTVKIWDVETKTVVTEHALHQHTISTLHWSPRVKDLIVSGDEKGVVFCYWFNRNDSQHLFIEPRTIFCLTCSPHHEDLVAIGYKDGIVVIIDISKKGEVIHRLRGHDDEIHSIAWCPLPGEDCLSINQEETSEEAEITNGNAVAQAPVTKGCYLATGSKDQTIRIWSCSRGRGVMILKLPFLKRRGGGIDPTVKERLWLTLHWPSNQPTQLVSSCFGGELLQWDLTQSWRRKYTLFSASSEGQNHSRIVFNLCPLQTEDDKQLLLSTSMDRDVKCWDIATLECSWTLPSLGGFAYSLAFSSVDIGSLAIGVGDGMIRVWNTLSIKNNYDVKNFWQGVKSKVTALCWHPTKEGCLAFGTDDGKVGLYDTYSNKPPQISSTYHKKTVYTLAWGPPVPPMSLGGEGDRPSLALYSCGGEGIVLQHNPWKLSGEAFDINKLIRDTNSIKYKLPVHTEISWKADGKIMALGNEDGSIEIFQIPNLKLICTIQQHHKLVNTISWHHEHGSQPELSYLMASGSNNAVIYVHNLKTVIESSPESPVTITEPYRTLSGHTAKITSVAWSPHHDGRLVSASYDGTAQVWDALREEPLCNFRGHRGRLLCVAWSPLDPDCIYSGADDFCVHKWLTSMQDHSRPPQGKKSIELEKKRLSQPKAKPKKKKKPTLRTPVKLESIDGNEEESMKENSGPVENGVSDQEGEEQAREPELPCGLAPAVSREPVICTPVSSGFEKSKVTINNKVILLKKEPPKEKPETLIKKRKARSLLPLSTSLDHRSKEELHQDCLVLATAKHSRELNEDVSADVEERFHLGLFTDRATLYRMIDIEGKGHLENGHPELFHQLMLWKGDLKGVLQTAAERGELTDNLVAMAPAAGYHVWLWAVEAFAKQLCFQDQYVKAASHLLSIHKVYEAVELLKSNHFYREAIAIAKARLRPEDPVLKDLYLSWGTVLERDGHYAVAAKCYLGATCAYDAAKVLAKKGDAASLRTAAELAAIVGEDELSASLALRCAQELLLANNWVGAQEALQLHESLQGQRLVFCLLELLSRHLEEKQLSEGKSSSSYHTWNTGTEGPFVERVTAVWKSIFSLDTPEQYQEAFQKLQNIKYPSATNNTPAKQLLLHICHDLTLAVLSQQMASWDEAVQALLRAVVRSYDSGSFTIMQEVYSAFLPDGCDHLRDKLGDHQSPATPAFKSLEAFFLYGRLYEFWWSLSRPCPNSSVWVRAGHRTLSVEPSQQLDTASTEETDPETSQPEPNRPSELDLRLTEEGERMLSTFKELFSEKHASLQNSQRTVAEVQETLAEMIRQHQKSQLCKSTANGPDKNEPEVEAEQPLCSSQSQCKEEKNEPLSLPELTKRLTEANQRMAKFPESIKAWPFPDVLECCLVLLLIRSHFPGCLAQEMQQQAQELLQKYGNTKTYRRHCQTFCM

SEQ ID NO: 111 - protein, 564 aa, Homo sapiens
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 112 - protein, 349 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCHFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 113 - protein, 322 aa, Homo sapiens
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 114 - protein, 398 aa, Homo sapiens
MRTSGRRWAVLGSPHVCRGVVRTRGAPGLWGTSFNPRSLALPADRWFLEFEKVPLFMSRAPSEIDPRENPDLACLQSIIFDEERSPEEQAKTYKDEGNDYFKEKDYKKAVISYTEGLKKKCADPDLNAVLYTNRAAAQYYLGNFRSALNDVTAARKLKPCHLKAIIRGALCHLELKHFAEAVNWCDEGLQIDAKEKKLLEMRAKADKLKRIEQRDVRKANLKEKKERNQNEALLQAIKARNIRLSEAACEDEDSASEGLGELFLDGLSTENPHGARLSLDGQGRLSWPVLFLYPEYAQSDFISAFHEDSRFIDHLMVMFGETPSWDLEQKYCPDNLEVYFEDEDRAELYRVPAKSTLLQVLQHQRYFVKALTPAFLVCVGSSPFCKNFLRGRKVYQIR

SEQ ID NO: 115 - protein, 870 aa, Homo sapiens
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 116 - protein, 389 aa, Homo sapiens
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 117 - protein, 179 aa, Homo sapiens
MASQNRDPAATSVAAARKGAEPSGGAARGPVGKRLQQELMTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 118 - protein, 94 aa, Homo sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 119 - protein, 254 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 120 - protein, 741 aa, Homo sapiens
MGPPGPALPATMNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 121 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 1015 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSESDHEVPEPESEMKMRLPRRAKTAALEKSKLNLAQFLNEDLS

SEQ ID NO: 123 - protein, 482 aa, Homo sapiens
MASPEPRRGGDGAAQAARKTRVEANSPLPKNSGSLNEAEALNPEVTLSSEGSLNLEDILYLEDTGDLDETLYVQETEKAEEALYIEEAMQPDEALHVEEPGNPEETVCVEETTEPDRIQFVEGPVEPGKPTSPEHVVYEGETVTRAEKSNPEESLRAEQSPSMEENLSIEDLELLEGRFQQCVQAVAQLEEERDQLIHELVLLREPALQEVQQVHQDILAAYKLHAQAELERDGLREEIRLVKQKLFKVTKECVAYQYQLECRQQDVAQFADFREVLTTRATQLSEELAQLRDAYQKQKEQLRQQLEAPPSQRDGHFLQESRRLSAQFENLMAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKAMLLPKSLEQADAPTSQAGGMETQSQGAV

SEQ ID NO: 124 - protein, 1197 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 125 - protein, 1401 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLQFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 126 - protein, 930 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 127 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 128 - protein, 698 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 129 - protein, 1482 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGNERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 130 - protein, 719 aa, Homo sapiens
MALKDYALEKEKVKKFLQEFYQDDELGKKQFKYGNQLVRLAHREQVALYVDLDDVAEDDPELVDSICENARRYAKLFADAVQELLPQYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 131 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 132 - protein, 1360 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 133 - protein, 590 aa, Homo sapiens
MSSACDAGDHYPLHLLVWKNDYRQLEKELQGQNVEAVDPRGRTLLHLAVSLGHLESARVLLRHKADVTKENRQGWTVLHEAVSTGDPEMVYTVLQHRDYHNTSMALEGVPELLQKILEAPDFYVQMKWEFTSWVPLVSRICPNDVCRIWKSGAKLRVDITLLGFENMSWIRGRRSFIFKGEDNWAELMEVNHDDKVVTTERFDLSQEMERLTLDLMKPKSREVERRLTSPVINTSLDTKNIAFERTKSGFWGWRTDKAEVVNGYEAKVYTVNNVNVITKIRTEHLTEEEKKRYKADRNPLESLLGTVEHQFGAQGDLTTECATANNPTAITPDEYFNEEFDLKDRDIGRPKELTIRTQKFKAMLWMCEEFPLSLVEQVIPIIDLMARTSAHFARLRDFIKLEFPPGFPVKIEIPLFHVLNARITFGNVNGCSTAEESVSQNVEGTQADSASHITNFEVDQSVFEIPESYYVQDNGRNVHLQDEDYEIMQFAIQQSLLESSRSQELSGPASNGGISQTNTYDAQYERAIQESLLTSTEGLCPSALSETSRFDNDLQLAMELSAKELEEWELRLQEEEAELQQVLQLSLTDK

SEQ ID NO: 134 - protein, 239 aa, Homo sapiens
MQDPNADTEWNDILRKKGILPPKESLKELEEEAEEEQRILQQSVVKTYEDMTLEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDELEWKLSESGAIMTDLEENPKKPIEDVLLSSVRRSVLMKRDSDSEGD

SEQ ID NO: 135 - protein, 1234 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 136 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 137 - protein, 808 aa, Homo sapiens
MAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 138 - protein, 835 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 139 - protein, 821 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 140 - protein, 863 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLLLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 141 - protein, 770 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 142 - protein, 1309 aa, Homo sapiens
MLLNGDCPESLKKEAAAAEPPRENGLDEAGPGDETTGQEVIVIQDTGFSVKILAPGIEPFSLQVSPQEMVQEIHQVLMDREDTCHRTCFSLHLDGNVLDHFSELRSVEGLQEGSVLRVVEEPYTVREARIHVRHVRDLLKSLDPSDAFNGVDCNSLSFLSVFTDGDLGDSGKRKKGLEMDPIDCTPPEYILPGSRERPLCPLQPQNRDWKPLQCLKVLTMSGWNPPPGNRKMHGDLMYLFVITAEDRQVSITASTRGFYLNQSTAYHFNPKPASPRFLSHSLVELLNQISPTFKKNFAVLQKKRVQRHPFERIATPFQVYSWTAPQAEHAMDCVRAEDAYTSRLGYEEHIPGQTRDWNEELQTTRELPRKNLPERLLRERAIFKVHSDFTAAATRGAMAVIDGNVMAINPSEETKMQMFIWNNIFFSLGFDVRDHYKDFGGDVAAYVAPTNDLNGVRTYNAVDVEGLYTLGTVVVDYRGYRVTAQSIIPGILERDQEQSVIYGSIDFGKTVVSHPRYLELLERTSRPLKILRHQVLNDRDEEVELCSSVECKGIIGNDGRHYILDLLRTFPPDLNFLPVPGEELPEECARAGFPRAHRHKLCCLRQELVDAFVEHRYLLFMKLAALQLMQQNASQLETPSSLENGGPSSLESKSEDPPGQEAGSEEEGSSASGLAKVKELAETIAADDGTDPRSREVIRNACKAVGSISSTAFDIRFNPDIFSPGVRFPESCQDEVRDQKQLLKDAAAFLLSCQIPGLVKDCMEHAVLPVDGATLAEVMRQRGINMRYLGKVLELVLRSPARHQLDHVFKIGIGELITRSAKHIFKTYLQGVELSGLSAAISHFLNCFLSSYPNPVAHLPADELVSKKRNKRRKNRPPGAADNTAWAVMTPQELWKNICQEAKNYFDFDLECETVDQAVETYGLQKITLLREISLKTGIQVLLKEYSFDSRHKPAFTEEDVLNIFPVVKHVNPKASDAFHFFQSGQAKVQQGFLKEGCELINEALNLFNNVYGAMHVETCACLRLLARLHYIMGDYAEALSNQQKAVLMSERVMGTEHPNTIQEYMHLALYCFASSQLSTALSLLYRARYLMLLVFGEDHPEMALLDNNIGLVLHGVMEYDLSLRFLENALAVSTKYHGPKALKVALSHHLVARVYESKAEFRSALQHEKEGYTIYKTQLGEDHEKTKESSEYLKCLTQQAVALQRTMNEIYRNGSSANIPPLKFTAPSMASVLEQLNVINGILFIPLSQKDLENLKAEVARRHQLQEASRNRDRAEEPMATEPAPAGAPGDLGSQPPAAKDPSPSVQG

SEQ ID NO: 143 - protein, 904 aa, Homo sapiens
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 144 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 145 - protein, 792 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 146 - protein, 606 aa, Homo sapiens
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 147 - protein, 330 aa, Homo sapiens [sequence omitted]

SEQ ID NO: 148 - protein, 543 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 149 - protein, 529 aa, Homo sapiens [sequence omitted]

SEQ ID NO: 150 - protein, 561 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 151 - protein, 1474 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 152 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 153 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 154 - protein, 337 aa, Homo sapiens
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 155 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 156 - protein, 609 aa, Homo sapiens [sequence omitted]

SEQ ID NO: 157 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

What is claimed is:

1. A method of generating cells which secrete neurotrophic factors (NTFs) comprising incubating a population of undifferentiated mesenchymal stem cells (MSCs) in a differentiating medium comprising basic fibroblast growth factor (bFGF), platelet derived growth factor (PDGF), heregulin and cAMP under conditions that generate cells in industrial amounts sufficient for clinical practice, wherein said undifferentiated MSCs have not been precultured in another medium that induces differentiation and wherein said differentiating medium is devoid of isobutylmethylxanthine (IBMX), and further wherein the generating cells is effected in a single differentiation step, thereby generating the cells.

2. The method of claim 1, wherein said differentiating medium is devoid of triiodothyronine.

3. The method of claim 1, wherein said differentiating medium is devoid of xeno derived components.

4. The method of claim 1, further comprising culturing said population of undifferentiated MSCs prior to said incubating, wherein said culturing is effected under conditions that do not promote cell differentiation.

5. The method of claim 4, wherein said culturing is effected in a culture medium comprising platelet lysate.

6. The method of claim 1, further comprising analyzing an expression of CD44 and/or CD73 on a surface of said cells which secrete neurotrophic factors (NTFs).

7. The method of claim 6, further comprising analyzing an expression of CD105 on said surface of said cells which secrete NTFs.

8. The method of claim 6, further comprising comparing said expression with an expression of CD44 and/or CD73 on a surface of undifferentiated MSCs.

9. The method of claim 1 further comprising measuring an amount of a neurotrophic factor secreted from the cells which secrete NTFs.

10. The method of claim 1, wherein the differentiating agents of the differentiating medium consist of bFGF, platelet PDGF, heregulin and cAMP.

11. The method of claim 1, wherein a concentration of said bFGF is 5-50 ng/ml, a concentration of said PDGF is 1-30 ng/ml, a concentration of said heregulin is 5-100 ng/ml and a concentration of said cAMP is 0.5-10 mM.

12. The method of claim 1, wherein a concentration of said bFGF is 20 ng/ml, a concentration of said PDGF is 5 ng/ml, a concentration of said heregulin is 50 ng/ml and a concentration of said cAMP is 1 mM.

* * * * *